United States Patent 7,745,391 (HUMAN THROMBOSPONDIN POLYPEPTIDE) - sequence listing, part 129

SEQ ID NO: 357058 - DNA, 7823 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccgaatggcacccagtatggcccgcag

SEQ ID NO: 357059 - DNA, 8426 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggttctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357060 - DNA, 8919 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacgggttagttaccgctctcaaacctaccaaaactacaaaaactttaatagcagacggacagccagtgaccagccatggtctggactgtgaagttcactaccatttgtcaagaatcaccctttccaaatcctctgggttttgactttttggcttccacttcacccaaaatgttaaaatttttacttaattcatagccttccttggtttcatatttgtttgcatttaattcatgtttgagtctcttaactgatggatgcccacttgccttaaagcagcatacttattttttgtttatttattgtgagctttttactttattaagattttacagcgaaacccttacatgagtaattgaaatgaaattaaatgagattacagcataatgaagaagaaaactagaatctaacagatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357061 - DNA, 8517 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagagactaaatgatggcaatgagtacctcttccaagccaaaagacgatgaggaaatgaacacatggatccaggctatctcttccgccatctcctctgataaacacgaggtgtctgccagcacccagagcacgcccagcattcaggcgggcgcagacccttcccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357062 - DNA, 8330 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357063 - DNA, 8021 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357064 - DNA, 6698 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357065 - DNA, 7918 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttctcgcagagggggatttggcagggtcataggacaatagtggagggaaggtcagcagataaacaagtgaacaaaggtctctggttttcctaggcagaggaccctgcggacttccgcagtgttagtgtccctgggtccttgagattagggagtggtgatgactcttaacgagcatgctgccttcaagcatctgtttaacaaagcacatcttgcaccgcccttaatccatttaaccctgagtggacacagcacatgtaacagagagcacagggttgggggtaaggtcacagatcaacaggataagaatttttcttagtacagaacacaatgaaaagtctcccatgtctacctctttatacacagacacggcaac

SEQ ID NO: 357066 - DNA, 7545 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttctcaatggggtgaattttaataataagacatccggggggggggg

SEQ ID NO: 357067 - DNA, 7524 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccacacaactcttggccgtataccgggatactctaggaacagctatgaccaa

SEQ ID NO: 357068 - DNA, 2423 bp, Homo sapiens
aggtcacctaaggatcccaaattgaggtcgggtggagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357069 - DNA, 7326 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaacagcgtcgtcaccatgatgcagct

SEQ ID NO: 357070 - DNA, 7341 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagagactaaatgatggcaatgagtacctcttccaagccaaaagacgatgaggaaatgaacacatggatccaggctatctcttccgccatctcctctgataaacacgaggtgtctgccagcacccagagcacgccagcatccagccgcgcgcagaccctccccaccagcgccgtcgcctccgcacgtgaatcctctagagt

SEQ ID NO: 357071 - DNA, 7272 bp, Homo sapiens
  misc_feature (7243)..(7243): n is a, c, g, or t
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattaaagacgatgaggaaatgaacacatggatccaggctatctcttccgccatctcctctgataaacacgaggtgtctgccagcacccagagcacgcccagcattcaggcgggcgcagacccttcccaaccagngtggtaaccattccagcgggttccgttcc

SEQ ID NO: 357072 - DNA, 7237 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattagcttctccacctcgtccacgctgtggcatatctctcgggtggataggtacggctcctgtccaagcagccaggcctcggccacactggcgtctcttgagaactgatggacctccagaatcagtct

SEQ ID NO: 357073 - DNA, 9502 bp, Homo sapiens
  misc_feature (9038)..(9038): n is a, c, g, or t
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacgggttagttaccgctctcaaacctaccaaaactacaaaaactttaatagcagacggacagccagtgaccagccatggtctggactgtgaagttcactaccatttgtcaagaatcaccctttccaaatcctctgggttttgactttttggcttccacttcacccaaaatgttaaaatttttacttaattcatagccttccttggtttcatatttgtttgcatttaattcatgtttgagtctcttaactgatggatgcccacttgccttaaagcagcatacttattttttgtttatttattgtgagctttttactttattaagattttacagcgaaacccttacatgagtaattgaaatgaaattaaatgagattacagcataatgaagaagaaaactagaatctaacaggtatgacacattcagttattctaacagggcacagtactgtgctatatgtagccgcctttacagatgttattaacctatagtagtttactattaactaggaagactggtgtatgaggagggagacattctgtaataagattaaaacctaaagtcagctgtgtaacattccatgaaagatgcattcatttattgaagatgacaaaaaagggagtcagatatattctggaagctattttaattttaggcacacaatctcatacattttgagacccttgggtcatttattactttttacaaactagttcctctctttttttctgccaagtcctgaattgaaaactgtaggcttccttgcacagatgttgcagccagcctcaggagtaaagtgcccgctgactgctgccgccacctctgtctcgctccctgtcagtgctgctggcacgtgggacgcggcaggtgacagccgttctcagcatgttttagaagcttgcctcacagacttccatgcctctccattcagccgatgacttcagggtgtcaaactgttttaatttttcaaacaaatggaacagaagccattgtggttcatcctgattacttgaacgttgcacttggtggaccgtgcctgggagcgctcgcatgccccctggcttcagaagtcatgtcagtgtctctgtagacaaactccactgtacatcttggattaatcttctgattcattgttcattttctcaagactttttgtggaattctctgataaaggaagcttttaggatggtatctatcaggccaccagcaggaattgaaaatgttttcacaaaaatccttttccttagaaataaaagctggtgacagagatggtttccttgtaccgataaaaacaaaaccaaatccatattatacatcaaaaccttgtgagacattcacttgctcttttgccatatttagatgtgttagtggaatcagaaacctgttttgatatgtgttctccatgagttaagtctgatttgtctttttatttcatgatgcatgtcttttttttcttttgtcaggataacgtcatatagcatcttgtttgtttttccttatctctatgtacatatctatctacttctgactgtagatgggtatatagatagatgccaagcttcttatgttctgggggtagtatgcatcattattgggtctctgccttaaaacacatcaaaattcattttagacaaaaaaacttctgccttgtctttggtcattagggagctctaatgtgtgtttgtggctccaagttacattttgtgtttcattgatctatatgtatatatgtgatgttttcatatatatatgtgtgtgtgtttaaattttgtatcatcaggactgacacccaatttgacactttttgtatctagaagaccctccaaaaaaggaaccacataagcacacaagaaaagagtgctatgatgttcttagcatttgctatcatgcctatttttatctagatttttaaatgtagcttgtcataacaaaattttaattacaattggcttgtatgagaagaaaaagtatttttattgttttgagtgatgacgcagagactcaatgaacttgaaaatagcattgcttcgtgcactttgaataccaatcaggtgttttctgtgctactagttgtcacgttgcattcatgttcacctcctgatttaagtatctcgggtgtgcccagccactaaagcactctggactaatcgctaaagagaagcaacgtggggggtggggttgcgagggatgtgttcacatgtacccatcatttgatcatagcactgtgattgcttttgatgtgtgtctctagtggtgtgttgtctgttggcatgcttaaagcacatgtccattaaaattcattttgttcctttnaaaaaaaaaaaaaaaaaaaaaaaaaaaaaaaaaaaaaaaaaaaaaaaaaaaaaaaaaaaaggggggggggggaaaaataaccccggggggggccattgcccccccttttttttaaaggggggcccccaaaaggggggcgatataaaaaaaagacagacgggggcgggtaaaaaaccgcggcgagcggaaacacggccactggggtcattggggaagagagaccacctcgcgggggggacacagggggcaccaccccacaagatataggccggggaaaaaaaaatgggctttagtgtaccccgaccaatcgcgggggaaaatcgtccggtttattcaaattatgaggctccataaacacgagaagaagacagacagaagaggcgacgcacacagagagagagaagagacgaagtacagaggaagaaaacaagagcagaaagagagcaagacgagaacagcccaca

SEQ ID NO: 357074 - DNA, 6347 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357075 - DNA, 6954 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcactgtcaaactgttttaatttttcaaacaaatggaacagaagccattgtggttcatcctgattacttgaacgttgcacttggtggaccgtgcctgggagcgctcgcatgccccctggcttcagaagtcatgtcagtgtctctgtagacaaactccactgtacatcttggattaatcttctgattcattgttcattttctcaagactttttgtggaattctctgataaaggaagcttttaggatggtatctatcaggccaccagcaggaattgaaaatgttttcacaaaaatccttttccttagaaataaaagctggtgacagagatggtttccttgtaccgataaaaacaaaaccaaatccatattatacatcaaaaccttgtgagacattcacttgctcttttgccatatttagatgtgttagtggaatcagaaacctgttttgatatgtgttctccatgagttaagtctgatttgtctttttatttcatgatgcatgtcttttttttcttttgtcaggataacgtcatatagcatcttgtttgtttttccttatctctatgtacatatctatctacttctgactgtagatgggtatatagatagatgccaagcttcttatgttctgggggtagtatgcatcattattgggtctctgccttaaaacacatcaaaattcattttagacaaaaaaacttctgccttgtctttggtcattagggagctctaatgtgtgtttgtggctccaagttacattttgtgtttcattgatctatatgtatatatgtgatgttttcatatatatatgtgtgtgtgtttaaattttgtatcatcaggactgacacccaatttgacactttttgtatctagaagaccctccaaaaaaggaaccacataagcacacaagaaaagagtgctatgatgttcttagcatttgctatcatgcctatttttatctagatttttaaatgtagcttgtcataacaaaattttaattacaattggcttgtatgagaagaaaaagtatttttattgttttgagtgatgacgcagagactcaatgaacttgaaaatagcattgcttcgtgcactttgaataccaatcaggtgttttctgtgctactagttgtcacgttgcattcatgttcacctcctgatttaagtatctcgggtgtgcccagccactaaagcactctggactaatcgctaaagagaagcaacgtggggggtggggttgcgagggatgtgttcacatgtacccatcatttgatcatagcactgtgattgcttttgatgtgtgtctctagtggtgtgttgtctgttggcatgcttaaagcacatgtccattaaaattcattttgttccttttattttccttgttttcttggttagtgattcatttgcataaacattaatgatctctgcatactggtttggggttttct

SEQ ID NO: 357076 - DNA, 4947 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccaggaacccatgatgtccagaaacccgtccagaccccaatgatggta

SEQ ID NO: 357077 - DNA, 5089 bp, Homo sapiens
  misc_feature (4824)..(4824): n is a, c, g, or t
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcgtgagtcgacccctactgcnacacatggttctttccacgagcccccttgcctgtgctaaagcccacattctcacttctcagtcatcctcaccttgggccacgttggcaagctgagctgccaaagtcccgccgcctctggaagttcttctgggagatggcagaagaggaaggctggatacgggagaaggagaagatcctgtcctcggacgattacgggaaagacctgacaagcgtcatgcgcttgctcagcaagcaccgggcgttcgaggacgagatgagcggccg

SEQ ID NO: 357078 - DNA, 4340 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggtaaggtttgttcctgcctttgcttcctttcggtgaaagcagccctggctgccttttgaaatgttttggctggggcagctggtttaaaccacacctgtatggaattatatggataatttagagactgatttttttttccccatactcttaaggcattgaaatccatcacgttgtaggggacaggaattgaaagttgccataagagctgctttgccttacaaagtactgtttgatttcaactgccattgaggatctcttatgtgttcatagtatgtcttcataattgaggtattgatccaatttaaaagatacagtgagggccaggcatgatgactcactcctgtaatcccagctcttggggaggctgggacaggagaatcacttgagcccagcaggtcaagggtgaagttagccgtgatcgtgccactgcactccagcctggtggcagggtgagaccctgtctctt

SEQ ID NO: 357079 - DNA, 3428 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggcataaggccccacggcataagtgg

SEQ ID NO: 357080 - DNA, 2035 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcaccagcacgaattccct

SEQ ID NO: 357081 - DNA, 842 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaagtgcacgggatcctcttgaacagctatgaccactat

SEQ ID NO: 357082 - DNA, 572 bp, Homo sapiens
aaaatgtacctgcatacatttgtgttaaaacagagtacttctggtacatccatatgactcatgaaatggctttgtttcagttagactattctgtggctttttaatgtgttgtttgggttttggctgaacacagatccccaccacagcacaagcggcttccttgagaattattgcagctctgtccctggtgtttgtctgagctctcctggggagtccagcatgaaccctcaggctcaggtacttttctcctcagcagagttgagagttgcatagttactttagaaattaaacccaagctcccaggggtcctacaaacaactcacaggaattttgccagcccatggaatagactatttcctgtagttttaggttgtagctgcagttcctgtgaacctaattccatttggctcaggatgttagagcttcttgtccagtgtggtccagtttagcaaactagacaggaggacttcctgggttcctagaacctttttctgaaaagaggcagagtttgggactctaccaaacatcactctattttctcttagttggagttactggaagtgcgcagacag

SEQ ID NO: 357083 - DNA, 375 bp, Homo sapiens
gacggatgctcatcaagctgctggaggtcctctctggagagaggctggtgagtggagaccttaggaagtgccgtgtgttgtaggtggaaaatatttttgaaaaatcaagtgtgacttgtctcctgttgaattctgcacttaatggttgatagttttgaggagaatcttgagaagtgagttgagcgcttcagggagagccttagtgtcacattctgagcgtggatgatgttcttgagctgtaataaagccactttgttctggtaatttgcaaggttgccacctttggtcagaaagaacttggctggggttcctgccaagaacagggcatggtgctggaatttgaagggccaggcttgggcgctggcttctagatga

SEQ ID NO: 357084 - DNA, 361 bp, Homo sapiens
tcctgcatgggatatgggagttgggggatttttatttctctgtaattaagtggtgactaactttcttccttgaaattacagactaaatgatggcaatgagtacctcttccaagccaaagacgatgtaagtttctaaatgttatttctctccactacttaggagtttgcaagtgtttgtgtgatgatgggctttattcagaaagttcttcatgtaaatgatgatcagtgatggtttctatcactgggctccagtcaccagcactagaaggtgtttggttctgtctctagaaggcagtgaatatgatctcactgtccctttgccgaggcaggatcccttaaagtcgatggaatctttgcctgt

SEQ ID NO: 357085 - DNA, 398 bp, Homo sapiens
tgaggcagagtttcactcttgtcattcaggctggagtgcagtggcgcaatctcggctcactgcaacctctgcttcccaggttcaagcgattttcctgccttagcctaccaagtagctggcattacaggcacgtgccaccacgcccggctaatttttgtatttttagtagagacagggtttcacaatgttggccaggctagtctcgaactcctgacctcaagtgatctgcccgcctcggcctcccaaagtgctgggattacaagcatgagctactgtgcccgggtggattttttattttccttcttttcattccgtttctctgtaggacaactttgggtttgaccttcctgcagttgaggccgccacaaaaaagcacgaggccattgagacagacattg

SEQ ID NO: 357086 - DNA, 344 bp, Homo sapiens
ccttatcgcatggccctgcatttacatttagcagtgagctggtaatcataagaatatggggtgtagcttactgcctgccagtgagcctgcacccatgctgagctccctcacacagccacgttccttccttgatgttaaacaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgg

SEQ ID NO: 357087 - DNA, 3335 bp, Homo sapiens
  misc_feature (510)..(510): n is a, c, g, or t
aagtcttttttcctaataatccattttccacattgccatgagggtaaagggttccaatcaaaaccaccattaaactgcatagtttctagtcttccctcagccctgatgctaattatgatagtttgcatagacataacttaaacttgtgattctccctccttccagagctttttgtagccctttttccccccaaaattagttttgttcaaaatcaagcattgggcccagccattaagataagacctaataagtgagagatacagttcccaagagtttacagatccaggtgttcacatggtggtggccagtctaccgtttatcttgtcaaggttgttactgctaatttggtgtcactttggtcttgggcagcggtggtgggcgacgtatctaatgagcgtgccattgacttctccatgtttgtctgtgtacgaggggtgcaggttgtctgtaatccactaaagtgtcagccacacccagctttagtaactcgctaatcgcacaccctgggtntatcagccaggggctgctacagttaatggtacacagttgatggtacacaggctgaaaatgataatgaatcaagaccctactacatttccaaagccgaaaagccatgagggttacaatttaaatgagcttgggaaggaacgctcccgaagacgtctccagcctgaagggtcagagccgctggaagcctggctgtctctgggctttctcgtctcagtgcagcaaggcaccgtgatcaaccaacccgtgatggggaaggccctggttctgtctttgtttgggggtaaatagctgtgtggtgttgagtgactgtgattggcttttccagctcctttaacacaaactacaacccactcacgatacaacttcggcagatgtggtcaaattgatgtttgttgacttgcctcatttccttccagctcttaagttccaaagtctaactgggatggtagatgtgaaatgcatgattgtcgtcctaatttctgcatgtgtttatgacaatgtgttgaggggagggggaggagagccagagagcattttcaggaaccgaggtctttccttgtcttactctgggggaatgccatgtagctctgatagagttgtctatcggtctgtttgtgaatgccctttcgcttaaacttccagcccttctggtggcatccttggttgtaaggtggctgctgtataacgtccactctctttcatatttaatatgtgtgattgttactgttgtctttttgttttaaagtaaccataagaggagatgatctgagttatatttattgatcagaggaatagagtgcagtaaaactcatactggcatttcgcttttctcatttccctgtaaatgggcgggtattaatccattcccaccttctaatgtccttgatgtccagctggctttgtgggtgtgcaatggttttactgtactgcctcgatctgtgccaggcatttatacacagccacatgtgcgagtcaggtagagcgtatgtggtcacccccatggctcacggagttagctgaatggcctctccgctgtccctagatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357088 - DNA, 281 bp, Homo sapiens
tcatctcccgtaccgtctcatctcccgtaccgtctcatttcccttaccgtcctcatctcccttaccgtcctcatctcccttaccatcgctgaatggaaggatggcctcaatgaagcctgggccgacctcctggagctcattgacacaagaacacagattcttgccgcttcctatgaactgcacaagttttaccacgatgccaaggagatctttgacggtaagggagatgaggacggtaagggagatgagacggtaagggagatgagacggtaaggagatga

SEQ ID NO: 357089 - DNA, 8655 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatctaaaaaaaaaattaaataaaaaaaaaaaatctttttggggcgcccctgggccccggaaaagttttcaaaaacactctctttggggcccgggccccaaagggatagtcacaagggcgcaaacgggtcccaagagaacctggcaga

SEQ ID NO: 357090 - DNA, 8458 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357091 - DNA, 8459 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357092 - DNA, 9039 bp, Homo sapiens
  misc_feature (7950)..(7950): n is a, c, g, or t
  misc_feature (7956)..(7956): n is a, c, g, or t
  misc_feature (7959)..(7959): n is a, c, g, or t
  misc_feature (7966)..(7966): n is a, c, g, or t
  misc_feature (7968)..(7968): n is a, c, g, or t
  misc_feature (7970)..(7970): n is a, c, g, or t
  misc_feature (7981)..(7981): n is a, c, g, or t
  misc_feature (7984)..(7984): n is a, c, g, or t
  misc_feature (7987)..(7987): n is a, c, g, or t
  misc_feature (7989)..(7989): n is a, c, g, or t
  misc_feature (7992)..(7992): n is a, c, g, or t
  misc_feature (8007)..(8007): n is a, c, g, or t
  misc_feature (8009)..(8009): n is a, c, g, or t
  misc_feature (8013)..(8013): n is a, c, g, or t
  misc_feature (8015)..(8015): n is a, c, g, or t
  misc_feature (8019)..(8019): n is a, c, g, or t
  misc_feature (8032)..(8034): n is a, c, g, or t
  misc_feature (8042)..(8042): n is a, c, g, or t
  misc_feature (8049)..(8049): n is a, c, g, or t
  misc_feature (8053)..(8053): n is a, c, g, or t
  misc_feature (8075)..(8081): n is a, c, g, or t
  misc_feature (8084)..(8084): n is a, c, g, or t
  misc_feature (8086)..(8086): n is a, c, g, or t
  misc_feature (8090)..(8091): n is a, c, g, or t
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttncccccngcnccccccncncnccccccccatnccnccncnccncccccaccgccatgncngttnanaatncccgtaccccccnnngaaccccnccccganaccntcttaaataacccccccccccnnnnnnnttntntttnnctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatctagcacggtgactagttgttgttcttcctctgctgcgtgtgcatgcccagtagggaaactgcaaagggagaaatgacaaacaagaaacattttacaaccagtctgggctcacttttgcattttttatgcatgtctggtgcacaagctttgaaaactacagcaaacagtaataaatgtgactgttttgtagttatacattcaggctttatcttttatttatgaaaaagttaccagagcacttgtgaaacctgaactctgagataggggttggcaaatttgttctgtaaagggacagagatagtaaatattttaggctttgtaggccgtaactgtctctgttgctcaattctgctgttgcgtaatacaaaggcagccattgacggtatgtgaatgcctgggcatggctgtgttccagtaaaactatttaaggacataaatttgaatttcatataactttgacatgccatacaatattttgattttcttaatgatttcaaaatgtaaagtctattttatacagatcagacc

SEQ ID NO: 357093 - DNA, 7878 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacactttgcatccagagacactttgcatccagagacactttgcatccagagacactttgcatccagagacactttgcatccagag

SEQ ID NO: 357094 - DNA, 8514 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaagggaaaatatacttgggttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357095 - DNA, 8600 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggattttacagcgaaacccttacatgagtaattgaaatgaaattaaatgagattacagcataatgaagaagaaaactagaatctaacagatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357096 - DNA, 8449 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattaaagacgatgaggaaatgaacacatggatccaggctatctcttccgccatctcctctgataaacacgaggtgtctgccagcacccagagcacgcccagcattcaggcgggcgcagacccttcccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357097 - DNA, 7526 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcgcgggtcctctagagtaaccgcag

SEQ ID NO: 357098 - DNA, 9114 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacgggttagttaccgctctcaaacctaccaaaactacaaaaactttaatagcagacggacagccagtgaccagccatggtctggactgtgaagttcactaccatttgtcaagaatcaccctttccaaatcctctgggttttgactttttggcttccacttcacccaaaatgttaaaatttttacttaattcatagccttccttggtttcatatttgtttgcatttaattcatgtttgagtctcttaactgatggatgcccacttgccttaaagcagcatacttattttttgtttatttattgtgagctttttactttattaagattttacagcgaaacccttacatgagtaattgaaatgaaattaaatgagattacagcataatgaagaagaaaactagaatctaacaggtatgacacattcagttattctaacagggcacagtactgtgctatatgtagccgcctttacagatgttattaacctatagtagtttactattaactaggaagactggtgtatgaggagggagacattctgtaataagattaaaacctaaagtcagctgtgtaacattccatgaaagatgcattcatttattgaagatgacaaaaaagggagtcagatatattctggaagctattttaattttaggcacacaatctcatacattttgagacccttgggtcatttattactttttacaaactagttcctctctttttttctgccaagtcctgaattgaaaactgtaggcttccttgcacagatgttgcagccagcctcaggagtaaagtgcccgctgactgctgccgccacctctgtctcgctccctgtcagtgctgctggcacgtgggacgcggcaggtgacagccgttctcagcatgttttagaagcttgcctcacagacttccatgcctctccattcagccgatgacttcagggtgtcaaactgttttaatttttcaaacaaatggaacagaagccattgtggttcatcctgattacttgaacgttgcacttggtggaccgtgcctgggagcgctcgcatgccccctggcttcagaagtcatgtcagtgtctctgtagacaaactccactgtacatcttggattaatcttctgattcattgttcattttctcaagactttttgtggaattctctgataaaggaagcttttaggatggtatctatcaggccaccagcaggaattgaaaatgttttcacaaaaatccttttccttagaaataaaagctggtgacagagatggtttccttgtaccgataaaaacaaaaccaaatccatattatacatcaaaaccttgtgagacattcacttgctcttttgccatatttagatgtgttagtggaatcagaaacctgttttgatatgtgttctccatgagttaagtctgatttgtctttttatttcatgatgcatgtcttttttttcttttgtcaggataacgtcatatagcatcttgtttgtttttccttatctctatgtacatatctatctacttctgactgtagatgggtatatagatagatgccaagcttcttatgttctgggggtagtatgcatcattattgggtctctgccttaaaacacatcaaaattcattttagacaaaaaaacttctgccttgtctttggtcattagggagctctaatgtgtgtttgtggctccaagttacattttgtgtttcattgatctatatgtatatatgtgatgttttcatatatatatgtgtgtgtgtttaaattttgtatcatcaggactgacacccaatttgacactttttgtatctagaagaccctccaaaaaaggaaccacataagcacacaagaaaagagtgctatgatgttcttagcatttgctatcatgcctatttttatctagatttttaaatgtagcttgtcataacaaaattttaattacaattggcttgtatgagaagaaaaagtatttttattgttttgagtgatgacgcagagactcaatgaacttgaaaatagcattgcttcgtgcactttgaataccaatcaggtgttttctgtgctactagttgtcacgttgcattcatgttcacctcctgatttaagtatctcgggtgtgcccagccactaaagcactctggactaatcgctaaagagaagcaacgtggggggtggggttgcgagggatgtgttcacatgtacccatcatttgatcatagcactgtgattgcttttgatgtgtgtctctagtggtgtgttgtctgttggcatgcttaaagcacatgtccattaaaattcattttgttccttttattttccttgttttcttggttagtgattcatttgcataaacattaatgatctctgcatactggtttggggttttct

SEQ ID NO: 357099 - DNA, 7364 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacaaagagaagcggttcagcctttttggcaaaaagaaatgaactcctttccttcacctcctgcccttctcttaccttttcagtgaaattccagcatgcaagctcattgacacaagaacacagattcttgccgcttcctatgaactgcacaagttttaccacgatgccaaggagatctttgggc

SEQ ID NO: 357100 - DNA, 7338 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagagactaaatgatggcaatgagtacctcttccaagccaaaagacgatgaggaaatgaacacatggatccaggctatctcttccgccatctcctctgataaacacgaggtgtctgccagcacccagagcacgcccagcattcaggcgggcgcagacccttcccaccagcgccgtacacacgaacgggatcctcagag

SEQ ID NO: 357101 - DNA, 7319 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagagactaaatgatggcaatgagtacctcttccaagccaaaagacgatgaggaaatgaacacatggatccaggctatctcttccgccatctcctctgataaacacgaggtgtctgccagcacccagagcacgcagcatccaccgcgccaaccctccaccaactcactttccacctagg

SEQ ID NO: 357102 - DNA, 7204 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagagactaaatgatggcaatgagtacctcttccaagccaatcaggccacgtcgcgtccagcta

SEQ ID NO: 357103 - DNA, 7160 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtaacagcagcagaggctgccacagtaagatgggaagtcagcctgtgaagggataaggcgggccactcttgaattggaagagaagtatgtgctcatgtagttttattcctttggtagcttcctggacattgcattcttcttgggctgacgctggaaagcaggagtagaatgctggttattcactgagagaa

SEQ ID NO: 357104 - DNA, 7199 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggaatggtttcaagaagcaggaactggccagttcaatttattttttattatgctagcataattttaaaagtctatatacatgtgcttttgtgcctcagaccctttttggaatgaggtatggtataaatataaaaagtattttgttaaccagttaccaagaatgaaaactgattttgcacgtcggacaagatgatcacatacagtggcagccttgaaaagacctgtttcaga

SEQ ID NO: 357105 - DNA, 5800 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgacgatctacagggtgtcagacgagtctacagtgca

SEQ ID NO: 357106 - DNA, 5258 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatggcttgaaaagcctgagacagctgtcttgtgagggactgagatgcaggatttcataaac

SEQ ID NO: 357107 - DNA, 4141 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtagtgggtcagccagtagggggtcagccagtagtggg

SEQ ID NO: 357108 - DNA, 3385 bp, Homo sapiens
  misc_feature (3352)..(3352): n is a, c, g, or t
  misc_feature (3362)..(3363): n is a, c, g, or t
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagcaancaatgggagnnggatcctctagatcaccaccac

SEQ ID NO: 357109 - DNA, 2917 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaagattgtctccagcagcgacgtgggccacgatgagctattccacacagtctctggtcaagaaacacagggacgtggcggaagagatcgccaattcacaagattgtctccagccagcgacgtgggccacgattgagtattccacacaggctcgggctcaagaaacacaaggacgtggcggcagagatcgcccatgccatgattgtctcctgcagcgaag

SEQ ID NO: 357110 - DNA, 292 bp, Homo sapiens
aggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacaggtacagttttctgaggttcttaagggagccttgcaccttggggctctcaaacttctgaatcattggccagaagcccttgggagttta

SEQ ID NO: 357111 - DNA, 724 bp, Homo sapiens
acccggaagcgctcgtgaccaccatttccgacccgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcag

SEQ ID NO: 357112 - DNA, 2295 bp, Homo sapiens
acccggaagcgctcgtgaccaccatttccgacccgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcagtttttagagtcattttctggtatcgagcgaccacaccgaggagcacaccctgcttccaaggctgctgccttctgcacacagtgggggatccccacccaccctggctcccctcaagggctgcgtgcacagtgcccgctttccagttacctgacccaccctgagtccctattccattttgctcggggctgacctcagacatgccctgtggctcagctctgccactactcagaacaccagcctcagcttccctatgtcccccagattcagcagcccagcagggattgggggaaatgctcccacatcaggtgggtggtggcctggtccctgcagactggactggcttttcagccatctccaggaagcaacacctagcagacaactgtcccttaaccccaagggtgatgcacacttctcccctggtctttctgccccccgatgcccctacatttacacagcagtgcgcagacccttgccgcaacctgcttgtcttgctgaccctgctgtaggagcgcctaaactgagtgcccgtctcccctccaaaggcagctggcttgaatcctgtgggaacgtgcccttcaccctttgccagcagttgctggggagtctttccggcccctttctcagactcaccacctacctccaacctgcgcagaacaatcagcgtcctgaccacttgctagagatggcttcaggccgaccactccatcctcactgcaggccttcattccttctggcttccatcactgcatggccccctaagaggtccccctcctggcccttgtcactgtgcctcatgacagccactacgccctaagcctttggaggccagggacaaagtctcgttcactgtcctttccgctgcatgagtgcagtgtctggccaggtgcacggggcactcagtgcctgtcagcccttggtaaacagtcctggacaacagggtcaaggacagagccctgggcggccacattcggtgcgtgctcctgtgttgtggcaaagctgccttttctgcgtttcatgtcagtgaaggaagacagggatgtggcagagccctgcgggttgctcccatcactcactcggtttgtgccatagtcctcctgttcccaggcggtcccagggcctgcccctgatgggctggaggcaccaccaacctcccactcctctggcagtcacagctcagggaatgggcaagcagcaccaatgagaaaccagctgtgtggtggggtttccagagaagaggaaattccttctttcctggagagcgtgcagctgtaactcacagacgagacatccctgagctaccagcccgtggtcctgtactagtcctggcaaaggttccggtaactgcagcaacagatacctcctgcccctcctgcacagctgtggtcgatcgcaggacagccgcaggtgatgaaaaaccgtgaacccaggacgggcagggcgtgagaccgcctttcgagacgcgagcttccgcgatccggggtctctgtgcgaacgtgggcatcttggaagagtcccagccccgctcggggcgcacaggcaggcgctctcagcacggcacccgcgcctccgct

SEQ ID NO: 357113 - DNA, 2891 bp, Homo sapiens
tctcctgaagaatacaccacttagccaggtgtggtggctcgtgcctgtaatctcagctcttcgggaggctgaggcaggagattggcttgaatccagaaggcagaagttgcagtgggctgagatcacaccagtgtactccagcgtgggcgacagtgtgtgactgtgtctcaacaacaacaaaaagttttaataatgagtgatttctgatgacatagcaggtgaaataggaacttacagaaaggaaggggaatgttttggagcgaacggatggtttatgcaagtgtagcaaaatcttggtgattactgaatctggtcattatgctagtccctctgcttgtgtacattaagtttttcctaaaaggttgagggggtgggtattttgcagaaggcactctttggtgctttacaaagatcttcagggtaggcttaggaggtttgactttcccattttactcagggaactgtagttaagaaaggagacatacttggccgggcacggtggctcacgcctgtaatcccagcactttgtgagctgaatttaatgctcaaagagacggccccccttttctactccttaaactctggcattgttcactagcttctgaaatcctctgtggttcttgcaggcacttccaggttggcttaaagggttaccctaggccagcagtcagctcagtcagggtggtgaccaaggaccctgaacaaggtgtttggttccccgggccgacatcaggactggagtccagcctccctgcagattccacaggtgcttccctcacccgtgtccacatttatccttcagcatcctgcctggaagtcctctgctgtgccacccagataggattctcctaggccttccctccccccaggcgagtgtgcagctgggttcttcctgagccagcgccgcaaccacgcggagccggagtgtgtgtctcacactgacagcaggttctgattcattcttttttcagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcagtttttagagtcattttctggtatcgagcgaccacaccgaggagcacaccctgcttccaaggctgctgccttctgcacacagtgggggatccccacccaccctggctcccctcaagggctgcgtgcacagtgcccgctttccagttacctgacccaccctgagtccctattccattttgctcggggctgacctcagacatgccctgtggctcagctctgccactactcagaacaccagcctcagcttccctatgtcccccagattcagcagcccagcagggattgggggaaatgctcccacatcaggtgggtggtggcctggtccctgcagactggactggcttttcagccatctccaggaagcaacacctagcagacaactgtcccttaaccccaagggtgatgcacacttctcccctggtctttctgccccccgatgcccctacatttacacagcagtgcgcagacccttgccgcaacctgcttgtcttgctgaccctgctgtaggagcgcctaaactgagtgcccgtctcccctccaaaggcagctggcttgaatcctgtgggaacgtgcccttcaccctttgccagcagttgctggggagtctttccggcccctttctcagactcaccacctacctccaacctgcgcagaacaatcagcgtcctgaccacttgctagagatggcttcaggccgaccactccatcctcactgcaggccttcattccttctggcttccatcactgcatggccccctaagaggtccccctcctggcccttgtcactgtgcctcatgacagccactacgccctaagcctttggaggccagggacaaagtctcgttcactgtcctttccgctgcatgagtgcagtgtctggccaggtgcacggggcactcagtgcctgtcagcccttggtaaacagtcctggacaacagggtcaaggacagagccctgggcggccacattcggtgcgtgctcctgtgttgtggcaaagctgccttttctgcgtttcatgtcagtgaaggaagacagggatgtggcagagccctgcgggttgctcccatcactcactcggtttgtgccatagtcctcctgttcccaggcggtcccagggcctgcccctgatgggctggaggcaccaccaacctcccactcctctggcagtcacagctcagggaatgggcaagcagcaccaatgagaaaccagctgtgtggtggggtttccagagaagaggaaattccttctttcctggagagcgtgcagctgtaactcacagacgagacatccctgagctaccagcccgtggtcctgtactagtcctggcaaaggttccggtaactgcagcaacagatacctcctgcccctcctgcacagctgtggtcgatcgcaggacagccgcaggtgatgaaaaaccgtgaacccaggacgggcagggcgtgagaccgcctttcgagacgcgagcttccgcgatccggggtctctgtgcgaacgtgggcatcttggaagagtcccagccccgctcggggcgcacaggcaggcgctctcagcacggcacccgcgcctccgct

SEQ ID NO: 357114 - DNA, 2750 bp, Homo sapiens
  misc_feature (15)..(15): n is a, c, g, or t
  misc_feature (22)..(22): n is a, c, g, or t
aacttaggctaggtncgaggcngggtggtgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccacggagtctcgcgctgtcacccaggctggagtgcaatggcgcgatctaggcttaatgcaacctcgtctcccgggttcaagcgattttcccgccccagtctcccgagtaactgtgactgcaggtgtgcgccaccaagctattttttgtatttttagtagagaccgggttccgccatgttggtcaggctggtctcgaactccagatctgaaatgatctgcctgccttgccctcccaaagtgctgggattacaggcgtgagacaccgtgcccagctgggtttttgctgtttttaattttgaaacagggtcttgatttcgcttaggccagagtgatggcaccatcatagctcactgattttgctatttacttttagaaaaatattctttagatcaattagaggctttgctgggacataacatccagaagtcatttttaagtatcttcatgttttcttatttcagctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcagtttttagagtcattttctggtatcgagcgaccacaccgaggagcacaccctgcttccaaggctgctgccttctgcacacagtgggggatccccacccaccctggctcccctcaagggctgcgtgcacagtgcccgctttccagttacctgacccaccctgagtccctattccattttgctcggggctgacctcagacatgccctgtggctcagctctgccactactcagaacaccagcctcagcttccctatgtcccccagattcagcagcccagcagggattgggggaaatgctcccacatcaggtgggtggtggcctggtccctgcagactggactggcttttcagccatctccaggaagcaacacctagcagacaactgtcccttaaccccaagggtgatgcacacttctcccctggtctttctgccccccgatgcccctacatttacacagcagtgcgcagacccttgccgcaacctgcttgtcttgctgaccctgctgtaggagcgcctaaactgagtgcccgtctcccctccaaaggcagctggcttgaatcctgtgggaacgtgcccttcaccctttgccagcagttgctggggagtctttccggcccctttctcagactcaccacctacctccaacctgcgcagaacaatcagcgtcctgaccacttgctagagatggcttcaggccgaccactccatcctcactgcaggccttcattccttctggcttccatcactgcatggccccctaagaggtccccctcctggcccttgtcactgtgcctcatgacagccactacgccctaagcctttggaggccagggacaaagtctcgttcactgtcctttccgctgcatgagtgcagtgtctggccaggtgcacggggcactcagtgcctgtcagcccttggtaaacagtcctggacaacagggtcaaggacagagccctgggcggccacattcggtgcgtgctcctgtgttgtggcaaagctgccttttctgcgtttcatgtcagtgaaggaagacagggatgtggcagagccctgcgggttgctcccatcactcactcggtttgtgccatagtcctcctgttcccaggcggtcccagggcctgcccctgatgggctggaggcaccaccaacctcccactcctctggcagtcacagctcagggaatgggcaagcagcaccaatgagaaaccagctgtgtggtggggtttccagagaagaggaaattccttctttcctggagagcgtgcagctgtaactcacagacgagacatccctgagctaccagcccgtggtcctgtactagtcctggcaaaggttccggtaactgcagcaacagatacctcctgcccctcctgcacagctgtggtcgatcgcaggacagccgcaggtgatgaaaaaccgtgaacccaggacgggcagggcgtgagaccgcctttcgagacgcgagcttccgcgatccggggtctctgtgcgaacgtgggcatcttggaagagtcccagccccgctcggggcgcacaggcaggcgctctcagcacggcacccgcgcctccgct

SEQ ID NO: 357115 - DNA, 2457 bp, Homo sapiens
tacaaatacaaaaatcaggccgggcacggtgtctcatgcctgtaatcccgcactttgggaggctgaggcgggcgagacaccgtgccctgccttggtagctgaatttaatgctcaaagagacggccccccttttctactccttaaactctggcattgttcactagcttctgaaatcctctgtggttcttgcaggcacttccaggttggcttaaagggttaccctaggccagcagtcagctcagtcagggtggtgaccaaggaccctgaacaaggtgtttggttccccgggccgacatcaggactggagtccagcctccctgcagattccacaggtgcttccctcacccgtgtccacatttatccttcagcatcctgcctggaagtcctctgctgtgccacccagataggattctcctaggccttccctccccccaggcgagtgtgcagctgggttcttcctgagccagcgccgcaaccacgcggagccggagtgtgtgtctcacactgacagcaggttctgattcattcttttttcagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcagtttttagagtcattttctggtatcgagcgaccacaccgaggagcacaccctgcttccaaggctgctgccttctgcacacagtgggggatccccacccaccctggctcccctcaagggctgcgtgcacagtgcccgctttccagttacctgacccaccctgagtccctattccattttgctcggggctgacctcagacatgccctgtggctcagctctgccactactcagaacaccagcctcagcttccctatgtcccccagattcagcagcccagcagggattgggggaaatgctcccacatcaggtgggtggtggcctggtccctgcagactggactggcttttcagccatctccaggaagcaacacctagcagacaactgtcccttaaccccaagggtgatgcacacttctcccctggtctttctgccccccgatgcccctacatttacacagcagtgcgcagacccttgccgcaacctgcttgtcttgctgaccctgctgtaggagcgcctaaactgagtgcccgtctcccctccaaaggcagctggcttgaatcctgtgggaacgtgcccttcaccctttgccagcagttgctggggagtctttccggcccctttctcagactcaccacctacctccaacctgcgcagaacaatcagcgtcctgaccacttgctagagatggcttcaggccgaccactccatcctcactgcaggccttcattccttctggcttccatcactgcatggccccctaagaggtccccctcctggcccttgtcactgtgcctcatgacagccactacgccctaagcctttggaggccagggacaaagtctcgttcactgtcctttccgctgcatgagtgcagtgtctggccaggtgcacggggcactcagtgcctgtcagcccttggtaaacagtcctggacaacagggtcaaggacagagccctgggcggccacattcggtgcgtgctcctgtgttgtggcaaagctgccttttctgcgtttcatgtcagtgaaggaagacagggatgtggcagagccctgcgggttgctcccatcactcactcggtttgtgccatagtcctcctgttcccaggcggtcccagggcctgcccctgatgggctggaggcaccaccaacctcccactcctctggcagtcacagctcagggaatgggcaagcagcaccaatgagaaaccagctgtgtggtggggtttccagagaagaggaaattccttctttcctggagagcgtgcagctgtaactcacagacgagacatccctgagctaccagcccgtggtcctgtactagtcctggcaaaggttccggtaactgcagcaacagatacctcctgcccctcctgcacagctgtggtcgatcgcaggacagccgcaggtgatgaaaaaccgtgaacccaggacgggcagggcgtgagaccgcctttcgagacgcgagcttccgcgatccggggtctctgtgcgaacgtgggcatcttggaagagtcccagccccgctcggggcgcacaggcaggcgctctcagcacggcacccgcgcctccgct

SEQ ID NO: 357116 - DNA, 1742 bp, Homo sapiens
  misc_feature (15)..(15): n is a, c, g, or t
  misc_feature (22)..(22): n is a, c, g, or t
aacttaggctaggtncgaggcngggtggtgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggacccgtaagcgtggacccgggacacccgccggccagcgcactcgcggcccctgcgtttctgcgccgcgacccagctagtgtgcagccgcccggccaccctcagccccttcctttcataccttgcttcgaaactccgacaaattatgtcgccccgcaggcaaactgtgggacatccgttctcccgccccgccgccacccccactgtcaccccctgctccagcccctcgcccgggccactgcagagccgccttgacactctccctgcgtcgccagccaccgccctagtcgctgctgctctcatccctccggtggcttcccttccctttggcagctgaagtcaacccagccccttgccaaccctccagggctactatctgctgccgtggtgctcctcgaagagaccacgcctgctgccaagctctgcccacccggaaccccccgcatttctgggaggctggcgcctccactctgtccacgtgccgcctcattactgcgcctcaccactcccgtctcagcctcatgaacctagcatctaacgtaccccggtttttttttcttaccccgagacggagtctcgcgctgtcacccaggctggagtgcaatggcgcgatctaggcttaatgcaacctcgtctcccgggttcaagcgattttcccgccccagtctcccgagtaactgtgactgcaggtgtgcgccaccaagctattttttgtatttttagtagagaccgggttccgccatgttggtcaggctggtctcgaactccagatctgaaatgatctgcctgccttgccctcccaaagtgctgggattacaggcgtgagacaccgtgcccagctgggtttttgctgtttttaattttgaaacagggtcttgatttcgcttaggccagagtgatggcaccatcatagctcactgattttgctatttacttttagaaaaatattctttagatcaattagaggctttgctgggacataacatccagaagtcatttttaagtatcttcatgttttcttatttcagctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcag

SEQ ID NO: 357117 - DNA, 753 bp, Homo sapiens
  misc_feature (621)..(621): n is a, c, g, or t
  misc_feature (623)..(623): n is a, c, g, or t
  misc_feature (633)..(633): n is a, c, g, or t
  misc_feature (635)..(635): n is a, c, g, or t
  misc_feature (641)..(641): n is a, c, g, or t
acccggaagcgctcgtgaccaccatttccgacccgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcaaaaaaaaaaaaaaaaaaaattgggggntnaatgcggggngnggaaanaggaggttggaagggccttggtccatagtgtttctgaccaagttttctttgtcacggggaaattgcggctcccatattagggagcgataattgataaggcagttaactgtaa

SEQ ID NO: 357118 - DNA, 1320 bp, Homo sapiens
tctcctgaagaatacaccacttagccaggtgtggtggctcgtgcctgtaatctcagctcttcgggaggctgaggcaggagattggcttgaatccagaaggcagaagttgcagtgggctgagatcacaccagtgtactccagcgtgggcgacagtgtgtgactgtgtctcaacaacaacaaaaagttttaataatgagtgatttctgatgacatagcaggtgaaataggaacttacagaaaggaaggggaatgttttggagcgaacggatggtttatgcaagtgtagcaaaatcttggtgattactgaatctggtcattatgctagtccctctgcttgtgtacattaagtttttcctaaaaggttgagggggtgggtattttgcagaaggcactctttggtgctttacaaagatcttcagggtaggcttaggaggtttgactttcccattttactcagggaactgtagttaagaaaggagacatacttggccgggcacggtggctcacgcctgtaatcccagcactttgtgagctgaatttaatgctcaaagagacggccccccttttctactccttaaactctggcattgttcactagcttctgaaatcctctgtggttcttgcaggcacttccaggttggcttaaagggttaccctaggccagcagtcagctcagtcagggtggtgaccaaggaccctgaacaaggtgtttggttccccgggccgacatcaggactggagtccagcctccctgcagattccacaggtgcttccctcacccgtgtccacatttatccttcagcatcctgcctggaagtcctctgctgtgccacccagataggattctcctaggccttccctccccccaggcgagtgtgcagctgggttcttcctgagccagcgccgcaaccacgcggagccggagtgtgtgtctcacactgacagcaggttctgattcattcttttttcagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcag

SEQ ID NO: 357119 - DNA, 752 bp, Homo sapiens
  misc_feature (15)..(15): n is a, c, g, or t
  misc_feature (22)..(22): n is a, c, g, or t
aacttaggctaggtncgaggcngggtggtgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccctctggattaatcgaattacagctgctagccaggaacatggactgaagtatccagcgctcattgggaatttagttaaggtatgggtgagtatgtgggtcccactgaaattctggacatctgcagaaaccatcatgcggggcgtggtggtgcttcctgtagtcccagctaatcaggaggctgaggccagaggatccctggagactgacttctgggctgtagtttgctatgctgatggggtgtccatgttaagtgtggtatcaatatggtgacctcttgggagcaagggaccaccacgttgcctaaggaggggtgaaccagcccaggctggaaacggagcaggtcacaattcccatgttgatgagtgatgagattgtgcctaggaatagtgccagcaacagcctgggcaacatagtgagaccactctctacaaaaaaataaaatttgctgggtgtggtggta

SEQ ID NO: 357120 - DNA, 418 bp, Homo sapiens
  misc_feature (15)..(15): n is a, c, g, or t
  misc_feature (22)..(22): n is a, c, g, or t
aacttaggctaggtncgaggcngggtggtgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccacggagtctcgcgctgtcacccaggctggagtgcaatggcgcgatctaggcttaatgcaacctcgtctcccggtttttagcaagcccgacatgcaagggggatccttagagcgaccgcaacagcgg

SEQ ID NO: 357121 - DNA, 665 bp, Homo sapiens
ctcctgcccctcctgcacagctgtggtcgatcgcaggacagccgcaggtgatgaaaaaccgtgaacccaggacgggcagggcgtgagaccgcctgcgggaggatcagcgatgtcaagacgttacaaacgcacgaaccccctcgccgtctccctggcgtttgtgaggtcctgtccaagctccttcacacgtagatcaccgggcctcgctcccccgactccttccgtgggcctgaaccttgaggtacttaggcctccccacgctggaggggctctgtagggacgtcgaggccacgtttccagtcatccctccacccgtctctccccaggggctgagtgttgaaggcaagactttgcaggagtctggcgttaatacgcatccccaaagtctggagtcgataaggactgaagacacgacgccgacggcggccgggggacaccgggcatgcgcgtctcatccagggggaggccgagcggagcctctgaccctgccccgcgcccagggttcagcagtgggggtcgtcccgccccagatcccaccgagatggccccccttgacccacaggcctttcgagacgcgagcttccgcgatccggggtctctgtgcgaacgtgggcatcttggaagagtcccagccccgctcggggcgcacaggcaggcgctctcag

SEQ ID NO: 357122 - DNA, 428 bp, Homo sapiens
taagtttttcctaaaaggttgagggggtgggtattttgcagaaggcactctttggtgctttacaaagatcttcagggtaggcttaggaggtttgactttcccattttactcagggaactgtagttaagaaaggagacatacttggccgggcacggtggctcacgcctgtaatcccagcactttgtgaggctgaggcgggtggatcacgaggtcaggagatcgagaccatcctggctaacatggtgaaacaccatctctactaaaaatacaaaaagtagccaggtgcggtggcgggcacctgtagtcccagctacttgtgaggctgaggcaggagaatggcatgaacctgggaggtggagcttgcaatgagctgagatcgcaccactgcactccagcttgggcgacacagtgagactctgtttcaaaaa

SEQ ID NO: 357123 - DNA, 719 bp, Homo sapiens
  misc_feature (15)..(15): n is a, c, g, or t
  misc_feature (22)..(22): n is a, c, g, or t
aacttaggctaggtncgaggcngggtggtgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcag

SEQ ID NO: 357124 - DNA, 2199 bp, Homo sapiens
taccccagagatcccccacccacagcttcacccgagggatcccccaccccacggcttcacccccgggatctcccgcccacaggttcaccccagggatcccccacccaccgcatcacccgtcggttggcggtcagaaccgtgattcgagcctttgtgaaatgcaccaaagcccgatacctgaagaaaaagaacatgaggaccctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcagtttttagagtcattttctggtatcgagcgaccacaccgaggagcacaccctgcttccaaggctgctgccttctgcacacagtgggggatccccacccaccctggctcccctcaagggctgcgtgcacagtgcccgctttccagttacctgacccaccctgagtccctattccattttgctcggggctgacctcagacatgccctgtggctcagctctgccactactcagaacaccagcctcagcttccctatgtcccccagattcagcagcccagcagggattgggggaaatgctcccacatcaggtgggtggtggcctggtccctgcagactggactggcttttcagccatctccaggaagcaacacctagcagacaactgtcccttaaccccaagggtgatgcacacttctcccctggtctttctgccccccgatgcccctacatttacacagcagtgcgcagacccttgccgcaacctgcttgtcttgctgaccctgctgtaggagcgcctaaactgagtgcccgtctcccctccaaaggcagctggcttgaatcctgtgggaacgtgcccttcaccctttgccagcagttgctggggagtctttccggcccctttctcagactcaccacctacctccaacctgcgcagaacaatcagcgtcctgaccacttgctagagatggcttcaggccgaccactccatcctcactgcaggccttcattccttctggcttccatcactgcatggccccctaagaggtccccctcctggcccttgtcactgtgcctcatgacagccactacgccctaagcctttggaggccagggacaaagtctcgttcactgtcctttccgctgcatgagtgcagtgtctggccaggtgcacggggcactcagtgcctgtcagcccttggtaaacagtcctggacaacagggtcaaggacagagccctgggcggccacattcggtgcgtgctcctgtgttgtggcaaagctgccttttctgcgtttcatgtcagtgaaggaagacagggatgtggcagagccctgcgggttgctcccatcactcactcggtttgtgccatagtcctcctgttcccaggcggtcccagggcctgcccctgatgggctggaggcaccaccaacctcccactcctctggcagtcacagctcagggaatgggcaagcagcaccaatgagaaaccagctgtgtggtggggtttccagagaagaggaaattccttctttcctggagagcgtgcagctgtaactcacagacgagacatccctgagctaccagcccgtggtcctgtactagtcctggcaaaggttccggtaactgcagcaacagatacctcctgcccctcctgcacagctgtggtcgatcgcaggacagccgcaggtgatgaaaaaccgtgaacccaggacgggcagggcgtgagaccgcctttcgagacgcgagcttccgcgatccggggtctctgtgcgaacgtgggcatcttggaagagtcccagccccgctcggggcgcacaggcaggcgctctcagcacggcacccgcgcctccgct

SEQ ID NO: 357125 - DNA, 3313 bp, Homo sapiens
  misc_feature (15)..(15): n is a, c, g, or t
  misc_feature (22)..(22): n is a, c, g, or t
aacttaggctaggtncgaggcngggtggtgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggacccgtaagcgtggacccgggacacccgccggccagcgcactcgcggcccctgcgtttctgcgccgcgacccagctagtgtgcagccgcccggccaccctcagccccttcctttcataccttgcttcgaaactccgacaaattatgtcgccccgcaggcaaactgtgggacatccgttctcccgccccgccgccacccccactgtcaccccctgctccagcccctcgcccgggccactgcagagccgccttgacactctccctgcgtcgccagccaccgccctagtcgctgctgctctcatccctccggtggcttcccttccctttggcagctgaagtcaacccagccccttgccaaccctccagggctactatctgctgccgtggtgctcctcgaagagaccacgcctgctgccaagctctgcccacccggaaccccccgcatttctgggaggctggcgcctccactctgtccacgtgccgcctcattactgcgcctcaccactcccgtctcagcctcatgaacctagcatctaacgtaccccggtttttttttcttaccccgagacggagtctcgcgctgtcacccaggctggagtgcaatggcgcgatctaggcttaatgcaacctcgtctcccgggttcaagcgattttcccgccccagtctcccgagtaactgtgactgcaggtgtgcgccaccaagctattttttgtatttttagtagagaccgggttccgccatgttggtcaggctggtctcgaactccagatctgaaatgatctgcctgccttgccctcccaaagtgctgggattacaggcgtgagacaccgtgcccagctgggtttttgctgtttttaattttgaaacagggtcttgatttcgcttaggccagagtgatggcaccatcatagctcactgattttgctatttacttttagaaaaatattctttagatcaattagaggctttgctgggacataacatccagaagtcatttttaagtatcttcatgttttcttatttcagctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcagtttttagagtcattttctggtatcgagcgaccacaccgaggagcacaccctgcttccaaggctgctgccttctgcacacagtgggggatccccacccaccctggctcccctcaagggctgcgtgcacagtgcccgctttccagttacctgacccaccctgagtccctattccattttgctcggggctgacctcagacatgccctgtggctcagctctgccactactcagaacaccagcctcagcttccctatgtcccccagattcagcagcccagcagggattgggggaaatgctcccacatcaggtgggtggtggcctggtccctgcagactggactggcttttcagccatctccaggaagcaacacctagcagacaactgtcccttaaccccaagggtgatgcacacttctcccctggtctttctgccccccgatgcccctacatttacacagcagtgcgcagacccttgccgcaacctgcttgtcttgctgaccctgctgtaggagcgcctaaactgagtgcccgtctcccctccaaaggcagctggcttgaatcctgtgggaacgtgcccttcaccctttgccagcagttgctggggagtctttccggcccctttctcagactcaccacctacctccaacctgcgcagaacaatcagcgtcctgaccacttgctagagatggcttcaggccgaccactccatcctcactgcaggccttcattccttctggcttccatcactgcatggccccctaagaggtccccctcctggcccttgtcactgtgcctcatgacagccactacgccctaagcctttggaggccagggacaaagtctcgttcactgtcctttccgctgcatgagtgcagtgtctggccaggtgcacggggcactcagtgcctgtcagcccttggtaaacagtcctggacaacagggtcaaggacagagccctgggcggccacattcggtgcgtgctcctgtgttgtggcaaagctgccttttctgcgtttcatgtcagtgaaggaagacagggatgtggcagagccctgcgggttgctcccatcactcactcggtttgtgccatagtcctcctgttcccaggcggtcccagggcctgcccctgatgggctggaggcaccaccaacctcccactcctctggcagtcacagctcagggaatgggcaagcagcaccaatgagaaaccagctgtgtggtggggtttccagagaagaggaaattccttctttcctggagagcgtgcagctgtaactcacagacgagacatccctgagctaccagcccgtggtcctgtactagtcctggcaaaggttccggtaactgcagcaacagatacctcctgcccctcctgcacagctgtggtcgatcgcaggacagccgcaggtgatgaaaaaccgtgaacccaggacgggcagggcgtgagaccgcctttcgagacgcgagcttccgcgatccggggtctctgtgcgaacgtgggcatcttggaagagtcccagccccgctcggggcgcacaggcaggcgctctcagcacggcacccgcgcctccgct

SEQ ID NO: 357126 - DNA, 800 bp, Homo sapiens
acccggaagcgctcgtgaccaccatttccgacccgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcagaaaaaaacacacaacctcattaatataaaaaaccaacaaagcacacaataacaaatcacacaaaaacaaacacaaa

SEQ ID NO: 357127 - DNA, 996 bp, Homo sapiens
acccggaagcgctcgtgaccaccatttccgacccgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcagtttttagagtcattttctggtatcgagcgaccacaccgaggagcacaccctgcttccaaggctgctgccttctgcacacagtggtcgatcgcaggacagccgcaggtgatgaaaaaccgtgaacccaggacgggcagggcgtgagaccgcctttcgagacgcgagcttccgcgatccggggtctctgtgcgaacgtgggcatcttggaagagtcccagccccgctcggggcgcacaggcaggcgctctcagcacggcacccgcgcctccgct

SEQ ID NO: 357128 - DNA, 640 bp, Homo sapiens
  misc_feature (15)..(15): n is a, c, g, or t
  misc_feature (22)..(22): n is a, c, g, or t
aacttaggctaggtncgaggcngggtggtgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacagctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcag

SEQ ID NO: 357129 - DNA, 331 bp, Homo sapiens
  misc_feature (15)..(15): n is a, c, g, or t
  misc_feature (22)..(22): n is a, c, g, or t
aacttaggctaggtncgaggcngggtggtgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccaatcttctcgacagttacttatggggacacgaatgttca

SEQ ID NO: 357130 - DNA, 566 bp, Homo sapiens
aggcaacaagagtgaaactatctcaaaaaataaaaaaaacattgaggggccagtcatacccacctaatttagggatagggaatggtgattagcaacgattttcaaaatccacagcaccggccgagtagataaaacaggtggtgttgaaataggagataggagtgcctccctgtcacgctgtcacttggctctcctcccccaaggctcctgcagcttgctttgcttagggaatacaagccccacccctgaggcaggggccagacttgggggcaggttgggcagtaggcattgctatgtcctaggggaagtcgtgtgacagccataacaagacccatgaaaaggctggatcagtgacttcactcctgggcatggctcctgagatacttgtttggcacatgttggtacctggtgctttagtaataaaaactgaagaactcaggctgggcatggtggctcacacttgtaatcccagcactttgggaggccgaggcgggcagattacctgaggtcgggagttcgagaccagcctgaccgacatggagaaaccccgtctctactaaaaatac

SEQ ID NO: 357131 - DNA, 5741 bp, Homo sapiens
tagagcataaggtagagaggctcggtttattcggacgaggatagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgccgtgcagttcttgcctccctcacggggcgtcacccccagcccagctccgttgtacataaatgccttgtggcagagctcccggtgaacttctggatcccgtttctgatgcagattcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaaaaaaatgtacatcgag

SEQ ID NO: 357132 - DNA, 4047 bp, Homo sapiens
agtcggtaccgatacgctcctagacggcaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgccgtgcagttcttgcctccctcacggggcgtcacccccagcccagctccgttgtacataaatgccttgtggcagagctcccggtgaacttctggatcccgtttctgatgcagattcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaaaaaaatgtacatcgag

SEQ ID NO: 357133 - DNA, 6849 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtgagttgtcgccatctgtcaggccaggtttgtttcctccacagttctgggtgagtctgtccattgctcatctcctttgttggctgcttccccacaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgccgtgcagttcttgcctccctcacggggcgtcacccccagcccagctccgttgtacataaatgccttgtggcagagctcccggtgaacttctggatcccgtttctgatgcagattcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaaaaaaatgtacatcgag

SEQ ID NO: 357134 - DNA, 2585 bp, Homo sapiens
ggcggtagggcatatcgtcgaccacgcgctccgaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgccgtgcagttcttgcctccctcacggggcgtcacccccagcccagctccgttgtacataaatgccttgtggcagagctcccggtgaacttctggatcccgtttctgatgcagattcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaaaaaaatgtacatcgag

SEQ ID NO: 357135 - DNA, 1858 bp, Homo sapiens
gggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtgagttgtcgccatctgtcaggccaggtttgtttcctccacagttctgggtgagtctgtccattgctcatctcctttgttggctgcttccccacaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgccgtgcagttcttgcctccctcacggggcgtcacccccagcccagctccgttgtacataaatgccttgtggcagagctcccggtgaacttctggatcccgtttctgatgcagattcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaaaaaaatgtacatcgag

SEQ ID NO: 357136 - DNA, 6163 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaaccttttacaccaaccccgtgatcgtggggttgtaattacaaccccacgatcacacatagtattgtggtgtgttgaattcaatacg

SEQ ID NO: 357137 - DNA, 6207 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccgggttaggtctacctggccaggtagacctaacccaggttaacctaacccaggtacacctaacccaggtagacctaactagaagtgtgaaaacgtaggcttggattaaggcgacagcgatttctaggatagtcagtagaattagaatcgtgacgatgatcagtgtagagggaaggttaatggttgatatcgctagggtggtgcttccaatcaggtgcatgagtaggtggcctg

SEQ ID NO: 357138 - DNA, 5955 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcttttacaccaaccccgtgatcgtggggttgtaattacaaccccacgatcacacatagtattgtggtgtgttgaattcaatacg

SEQ ID NO: 357139 - DNA, 1168 bp, Homo sapiens
tatgttgattggcattgcagggatgcctctctgattatactacccgcgtttcaagggtgtctagaccatgcagggacgcctgccttgtccatcacccttagcggcaagtcccgcttttctggggaaggggcaagtacctcaaccccttctctttctctctcctccttctctgcttttctgggagaggggcaagtacccctcaaccccttctccttcacccttagcggcaagtcccgcttttctatggggcaagaacaccccaatcccttgtttctgcaccccaacctcttatctctgtgccccaatcacttatttctacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgccgtgcagttcttgcctccctcacggggcgtcacccccagcccagctccgttgtacataaatgccttgtggcagagctcccggtgaacttctggatcccgtttctgatgcagattcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaaaaaaatgtacatcgag

SEQ ID NO: 357140 - DNA, 5135 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtgcaggaggaggacgcccgggggaagaggg

SEQ ID NO: 357141 - DNA, 4381 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaaccagcattgatcttttcagcaatctgctccatggggaggttattggca

SEQ ID NO: 357142 - DNA, 4150 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttgtgacgacttgaactgcatcttaatatgcgtagctctgcgtccagcc

SEQ ID NO: 357143 - DNA, 2730 bp, Homo sapiens
  misc_feature (2689)..(2689): n is a, c, g, or t
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacaggaactgtgagaggtccctgcttgtgggggtcctgtggtgggaggtggtttaagggaactggtctggggttgggatggagatgcctagaagaaggagtcggttataacnctccaaaggcagagagagagaagtgggagaccccagggtgg

SEQ ID NO: 357144 - DNA, 2470 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggacacgaatgttcagggacaagctcgagttcgta

SEQ ID NO: 357145 - DNA, 2354 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaagctggtgctggagaatggcgacctgattatggccatccgcctgtatgcagtctgtgagcacgtcaatgggctcctctcaggcaacatc

SEQ ID NO: 357146 - DNA, 2332 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggatgcttaacgagaaaccacaaaggaactccatccaaatagaggctagagtttcctaaggagaaagaaacatccctggggactgagctagttcatcagtacagagacaaaattacagaaattgaggggaaaagtacaattctgggagaaagcaatggagactactgaattcacactcactgcccctctggaaactgtgttccaagatctccctcactcaaaaattggatggctttttattttgtttttaccaagtaaaatggttcccttgcaataa

SEQ ID NO: 357147 - DNA, 590 bp, Homo sapiens
ccaggtagacctaacagcacaagtggagaacaagacaagagtctgcatcagaaacgggatccagaagttcacccacctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctgggttaggtctacctggccaggtagacctaactacttcaggtgatttgtaatctctaggccataggaaatgggataatgtaggcttttgatgcaatggattggactttgtaaaggtgaagcttcaagctatctacttagggtgcctggggactttgaagagttatagaactatggtgcagctgcagtggcctttctgtaaatgtactactttctgttcacacatctcaccctgggtaggtctaccctacctgggttagtctaccaggggtcgcgc

SEQ ID NO: 357148 - DNA, 425 bp, Homo sapiens
tcatggctcctcaccccaccaggttttggtgacgacttgaactgcatctttaatgatgacaatgcagagaagctggtgctccgtattcgcatcatgaacagcgatgagaacaagatgcaagaggtaatgggggtcctagaagtcagcgtgtcacatgtataaaacgcatgaatcacgttagagaccaaagaaaagaagatgcaatcaacgttgaggggcggccaggcgtggtggctcacgcctgtaatcccagcactttgggaggctgaggcgggtggatcacctgagctcgggagttcgagaccagcctgaccaacatggagtaaccccgtctctactaaaaataaaaattagccgggcatggtggtatgtgcctgtaatcccagctacttgggaggctgaggcaacaagagtgaaactatctc

SEQ ID NO: 357149 - DNA, 345 bp, Homo sapiens
tacggcgaagacggcctggcaggcgagagcgttgagttccagaacctggctacgcttaagccttccaacaaggcttttgagaagaagtgaggaggcgggcaggcgggtggttcttgcccctggggctcagggcctgagtagtaggattcccatacctattccagagagatagcctggtatgtgtcttgcactagagcttacctttcagcatccttccccacctatctgaaacagctgtgtgacatgggggaggtggtggatggaggtggatttaagattggtccccacatcgtccctgctgatattataaagcagatgcagaggggtgggcctgtactcaggtcc

SEQ ID NO: 357150 - DNA, 561 bp, Homo sapiens
catgggtgcaagggtgtcaccagtccatgattgctgttcttgctcctcacgatttcctgtgttcctctttgcagccaccggcatgttctttggttcagcacccagtcccatgggtggaatctctcctgccatgacaccttggaaccagggtgcaacccctgcctatggcgcctggtcccccagtgttggtgagtaacctgatccaggaagagggccctccaggtggttcagaggtggataagctgggatcgtgaacggtagccattgttggaactctgaaggccgcagagggctagtgaaaggtggggcagggagaattgggggcctttggtctcccgctctggccttaacttgcttctctcactctatagggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtgagttgtcgccatctgtcaggccaggtttgtttcctcc

SEQ ID NO: 357151 - DNA, 396 bp, Homo sapiens
gtggctggggctggcggagacttttgggaaggaggggtcagaggcctggagggaggaaactggaagggaaggaaacaggaggggctggcctggtgtggagggaaatggtccaccctctgggctctgatggcccctgtctctccttggaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcgg

SEQ ID NO: 357152 - DNA, 213 bp, Homo sapiens
tgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtagggcttggcttctggatatgtgaggaca

SEQ ID NO: 357153 - DNA, 6752 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgccgtgcagttcttgcctccctcacggggcgtcacccccagcccagctccgttgtacataaatgccttgtggcagagctcccggtgaacttctggatcccgtttctgatgcagattcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaaaaaaatgtacatcgag

SEQ ID NO: 357154 - DNA, 4895 bp, Homo sapiens
tcagggcgacatactgcacttctggctccccagacagcaaagtgacaagtggaggggctaacttcttcagcagcatattgtagtagtcagaatccttaggtaacaattctagaaacttcattaggacttttaccgctgaaagcaccactgctgagttggcatgggatagccggggagttacccgctcacagatgctgagcggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgccgtgcagttcttgcctccctcacggggcgtcacccccagcccagctccgttgtacataaatgccttgtggcagagctcccggtgaacttctggatcccgtttctgatgcagattcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaaaaaaatgtacatcgag

SEQ ID NO: 357155 - DNA, 2635 bp, Homo sapiens
ttctagaggatccctcacgccatgtcacaacctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgccgtgcagttcttgcctccctcacggggcgtcacccccagcccagctccgttgtacataaatgccttgtggcagagctcccggtgaacttctggatcccgtttctgatgcagattcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaaaaaaatgtacatcgag

SEQ ID NO: 357156 - DNA, 2881 bp, Homo sapiens
agctaaactaattttgcaaatcaaacagacacttgaaaaactagcatatgtaaaggtattcgttaatcctgtgaatggtagcttttgcacagaacttccaatagccaaaccaaaaccaaatctattgtagttatatacttcatttaacctaggtcacaagacccagggaatcttctaacctcacttttacagtaggtattactcttgtgacatttttttggttatcaacaacctaaatataaattactttggaaaaagtaaggctgtcttgcaaaatgatcccagctctgattagcagccctctggagttcagtacttaagcggatcagaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgccgtgcagttcttgcctccctcacggggcgtcacccccagcccagctccgttgtacataaatgccttgtggcagagctcccggtgaacttctggatcccgtttctgatgcagattcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaaaaaaatgtacatcgag

SEQ ID NO: 357157 - DNA, 6105 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccagtcccaaatattcacccacctctcccaagtactcgcctaccagtccttttacaccaaccccgtgatcgtggggttgtaattacaaccccacgatcacacatagtattgtggtgtgttgaattcaatacg

SEQ ID NO: 357158 - DNA, 6253 bp, Homo sapiens
  misc_feature (6239)..(6239): n is a, c, g, or t
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagcttcactgatgccccacccagccacggcaacgacatggtttatatatctggtgtcctgctacttcggcatagaagcctccggtgctaattagccagtctctctgttgccagtattccacacctgatgggaccaattgcctagaattctgccatcatcattctcccctccccgagagggagccgtagtctcccaccctcccgagggtgtagttccaggatggcgtggcactctttgaattccttgcatgtcccacaattggttaaaccatgtcacactcctggtccttggcctggtagtgtgcaaganctcgtcagtccgct

SEQ ID NO: 357159 - DNA, 6233 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccgggttaggtctacctggccaggtagacctaacgtccaagatagaatcttagttcaactttaaatttgcccacagaaccctctaaatcctcttgtaaatttaactgttagtccaaagaggaacagctctttggacactaggaaaaaacccttgtagagcgagtaaaaaatttaacacccatagtaggcctaaaagcagccaccaattaagaaagcgttcaagctcaacacccactacctgggttagtctaccagggtag

SEQ ID NO: 357160 - DNA, 1093 bp, Homo sapiens
cctaaaggaagaagtatcaaagccacgaaacaaagaagcaatcatttatattgaacagtgctattgaaacttctaaaactaggcctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgccgtgcagttcttgcctccctcacggggcgtcacccccagcccagctccgttgtacataaatgccttgtggcagagctcccggtgaacttctggatcccgtttctgatgcagattcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaaaaaaatgtacatcgag

SEQ ID NO: 357161 - DNA, 5537 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctgggttaggtctacctggccaggtagacctaactacttcaggtgatttgtaatctctaggccataggaaatgggataatgtaggcttttgatgcaatggattggactttgtaaaggtgaagcttcaagctatctacttagggtgcctggggactttgaagagttatagaactatggtgcagctgcagtggcctttctgtaaatgtactactttctgttcacacatctcaccctgggtaggtctaccctacctgggttagtctaccaggggtcgcgc

SEQ ID NO: 357162 - DNA, 3791 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgtgagtgttgtgctcttcacagcagtcttcttttcctccttttacctgttgacttctgtggtttccaagagcagcccacttctgtccacaacctacagaataggttctgtaggttctgtcccacctaataatagctctcattcatggagagactgcttgtacctt

SEQ ID NO: 357163 - DNA, 2486 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggctacagctattgttgtgtgccttctcgat

SEQ ID NO: 357164 - DNA, 2214 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagcgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatccgtactgcccgggtacgagctgatatta

SEQ ID NO: 357165 - DNA, 1681 bp, Homo sapiens
gagagcgcggccgggacggttggagaagaaggcggctccccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttcgccgcctccttccctccgccaccttcccctcctccggctttttcctcccaactcggggaggtccttcccggtggccgccctgacgaggtctgagcacctaggcggaggcggcgcaggctttttgtagtgaggtttgcgcctgcgcaggcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccaggcagctcgttgtccaccatggtggccacatggaactggaggagcttcacatcctctaca

SEQ ID NO: 357166 - DNA, 338 bp, Homo sapiens
caggtgctgtgtgtggaggggtctcatggggccggtctgctctgttcaggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacgtgagtatgaggccccagctgcggtacctgcttgcgtcggcgaggcgggggggcaggccatgggtgcaagggtgtcaccagtccatgattgctgttcttgct

SEQ ID NO: 357167 - DNA, 361 bp, Homo sapiens
gggagcacagctgggccagctggcagcagtgcatgcacctcctgtcccacacaccccacatgctgctcttcctgcccttgcacctccctccttagcccatgcctccctgtgctggatgtgtcaggagtgtccaagtagcagaagccatctctggctcaagagcaccattagacctgccaggtctggctgagcctcatgtgtattcgctacagccttccctctggatgccactgtctccagcaaaggtttcggccaattgatttccaggttggtctcacttggggattacatccggctgggctgccaaccagagccctgacagctggagcaggactcttgtctacaaggagtgggcccacac

SEQ ID NO: 357168 - DNA, 2015 bp, Homo sapiens
tttttttcagtgttacattaaaaagacgtttatgaaagcaatttataaagccctagtgggagaccgagattggtgttaatgtaactggagtaagggctgctccgattgctgcagaaattcgacattagccttcaccgcacctgcggagcagcgggagccaggtgagcagcaatttcccctcagggacttcctccgcgttctccgcattttctgtcggcggaactgaatcccaacagtagaaaaacgtggctccgcccatcacctttcctttaaaggacgcggggtgaagccccgcccactacggagagcgaaggggactcgccgcagatccgctgtacttgcgtccgctacagtatgtcaatcgcttgccccagcacagtgggctccgtggcttaagacttgaaccaagtaaacgaagttctcttactgagaagtctcagtttcaaaagagcttctcctcatcaactggggatgattacagttcttcctaaaaaagcctacttgatgtgaagacaatgaggatgaagacctttatggtgatccacttccacttaatagatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttgagcaaaaatgaggagaaggcatataaagaaactcaagagacccaggaaagagacactttgaacaaagaccatggaaatgataaggaatcaaatgttctgcatcagtaattttaataaagaaaagcatgctctgagagaaaaaaaagctcgctccttggtctgcagtcctttaaacaaagcagtgcagttcttagccaagggtaagtactgcaactgtcgagagcatcttgtcttccacacagttgggtgactctccgttttgacacaaagataagccttgcccttgtttccttttgggagggatatatccactgagatgagaggccaaactccgtttttcacgagattttttgactttgagcttcattttcttcttgtcaggatcatgtacaacagcatgcctagtgagactttgtttcattgcaaatgttttgccacagccagcatgttcacacacaaaagggcggctttcctcatggaaggagaggatatggctttggagattaaacacagttgtataggttcttccacagccttctcttggacagcgacataatcccttctggggcatgagtttatgtgttgcttaaggaacttgcgttaaagttttccggcaacttcacatggattcctttgaatgagttcaaatgttcccatgctaagctgagtctgtgccatagcaaaccatgatatagcaagtctccagaatgtgtacgaatcaatactcc

SEQ ID NO: 357169 - DNA, 529 bp, Homo sapiens
tttttttcagtgttacattaaaaagacgtttatgaaagcaatttataaagccctagtgggagaccgagattggtgttaatgtaactggagtaagggctgctccgattgctgcagaaattcgacattagccttcaccgcacctgcggagcagcgggagccaggtgagcagcaatttcccctcagggacttcctccgcgttctccgcattttctgtcggcggaactgaatcccaacagtagaaaaacgtggctccgcccatcacctttcctttaaaggacgcggggtgaagccccgcccactacggagagcgaaggggactcgccgcagatccgctgtacttgcgtccgctacagtatgtcaatcgcttgccccagcacaggtaatgctaaatatgaggcgtgcggagcggtgcgcggaccggcatcgggagggcgtggccttagggggcgcccctgtggaggaggcacccggaaggtcagggctaccccgtcccgccggtaccgagggcggagaggctccgcaggtcctg

SEQ ID NO: 357170 - DNA, 367 bp, Homo sapiens
ggatgggagaactggcttagtttggaaggtaatcagaagaatgcgctaaggatctggcgtttcctaaaccaaggacgagagtactgtatttcaaaaaccgaatggccagtgtggcctaggcataaagaagaaactggagaggtgggaagggccttttggcctggcgaaggtgtagatctttaatctcggggcagttttatttaaggtgaggaaggtcctgggtgtagtgaccgcagtgcagtgggaactggttgccagggctcaagccgagttaggagactggcaggaatccaaacgaggtggtcgatgttttaaactgacggtggtgacagtggatacggagaggactggatggattcgagtgggg

SEQ ID NO: 357171 - DNA, 395 bp, Homo sapiens
cgcagtacgtcgctacgtcccgtctctagccctggcgctccgccggtcccgttctgcagctgtcattcttctctacagaagagcttctcctcatcaactggggatgattacagttcttcctaaaaaaggtaggataaatgctcagttctttttatttaattagcaattttcaaagtaaaaaatcaatataatagtcccatgcagttgtggcaaattatcattttcatagatttttgtatattcagtatattgaaatgaatgacagtgattatgccttactgtttaaattacaccaaaattgaccagtgggagtctcttcatgctgccaaactgtaaatgacatgtaaacaaacaaaatcataataccatcatggaaatctgaaagctaaatattt

SEQ ID NO: 357172 - DNA, 1906 bp, Homo sapiens
tttttttcagtgttacattaaaaagacgtttatgaaagcaatttataaagccctagtgggagaccgagattggtgttaatgtaactggagtaagggctgctccgattgctgcagaaattcgacattagccttcaccgcacctgcggagcagcgggagccaggtgagcagcaatttcccctcagggacttcctccgcgttctccgcattttctgtcggcggaactgaatcccaacagtagaaaaacgtggctccgcccatcacctttcctttaaaggacgcggggtgaagccccgcccactacggagagcgaaggggactcgccgcagatccgctgtacttgcgtccgctacagtatgtcaatcgcttgccccagcacagctgtcattcttctctacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttgagcaaaaatgaggagaaggcatataaagaaactcaagagacccaggaaagagacactttgaacaaagaccatggaaatgataaggaatcaaatgttctgcatcagtaattttaataaagaaaagcatgctctgagagaaaaaaaagctcgctccttggtctgcagtcctttaaacaaagcagtgcagttcttagccaagggtaagtactgcaactgtcgagagcatcttgtcttccacacagttgggtgactctccgttttgacacaaagataagccttgcccttgtttccttttgggagggatatatccactgagatgagaggccaaactccgtttttcacgagattttttgactttgagcttcattttcttcttgtcaggatcatgtacaacagcatgcctagtgagactttgtttcattgcaaatgttttgccacagccagcatgttcacacacaaaagggcggctttcctcatggaaggagaggatatggctttggagattaaacacagttgtataggttcttccacagccttctcttggacagcgacataatcccttctggggcatgagtttatgtgttgcttaaggaacttgcgttaaagttttccggcaacttcacatggattcctttgaatgagttcaaatgttcccatgctaagctgagtctgtgccatagcaaaccatgatatagcaagtctccagaatgtgtacgaatcaatactcc

SEQ ID NO: 357173 - DNA, 1132 bp, Homo sapiens
aggcgaagggcgcctgcgcaggacatgctggacaaatgcgttgttcttgctgcctgctgttgcgggaggaggccttatgggggaaggtcgcgaagtgactgggattttttttctcatttgtcatttagtgggctccgtggcttaagacttgaaccaagtaaacgaagttctcttactgagaagtctcagtttcaactgtcattcttctctacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttgagcaaaaatgaggagaaggcatataaagaaactcaagagacccaggaaagagacactttgaacaaagaccatggaaatgataaggaatcaaatgttctgcatcagtaattttaataaagaaaagcatgctctgagaga

SEQ ID NO: 357174 - DNA, 1748 bp, Homo sapiens
cagttaattatattagaagtttatcaattggtgtttatgaatcaccaagcattttatgtactgcatcctcataaataaacccctaagatgacactcgcttttggagttggcactacaagatgcatgagaaatacagttgatcctagaacaacacaggtttgaactgcatggggtccacatatatgtggattttcctccacctttgccacccctgagagaagaccaacccctcctcttgctcctcctcctcagcctacttgatgtgaagacaatgaggatgaagacctttatggtgatccacttccacttaatagtaaatatattttctcttctttatgattttcttaatgacatttcttttctctagcttgctgtattgtaagaatacagtatataatacatatggcatacaaaatatgtgttaatcaactgcttatgttattcataaggctttcagtcaacagtaagctattagtaagtttttgaggagtcaaagttatacacagattttcaactgcacagggggtctgtttccctaactcccaagttgttcaggggtcaactaagtagtcaaatgagatcatgtgtacagaaaaaaaaaaaaagtgaaaccaaaatgctatgtaaatctggtttattctaatagccacttgtcttggggacagtatcaccatgagttagtctggccagagtcacctgctagtccgctttatcagtgtagacttcctgtgtgtggatctgaaagtctagagaacagcatttccctcacacttgcagttacagcctccacaacctcacacacaccctgccatgtaccacaatgtcagaccaagggaataagtgattgaattttaatgaactcttcttactactttcttaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttgagcaaaaatgaggagaaggcatataaagaaactcaagagacccaggaaagagacactttgaacaaagaccatggaaatgataaggaatcaaatgttctgcatcagtaattttaataaagaaaagcatgctctgagaga

SEQ ID NO: 357175 - DNA, 1203 bp, Homo sapiens
tttttttcagtgttacattaaaaagacgtttatgaaagcaatttataaagccctagtgggagaccgagattggtgttaatgtaactggagtaagggctgctccgattgctgcagaaattcgacattagccttcaccgcacctgcggagcagcgggagccaggtgagcagcaatttcccctcagggacttcctccgcgttctccgcattttctgtcggcggaactgaatcccaacagtagaaaaacgtggctccgcccatcacctttcctttaaaggacgcggggtgaagccccgcccactacggagagcgaaggggactcgccgcagatccgctgtacttgcgtccgctacagtatgtcaatcgcttgccccagcacagctgtcattcttctctacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatgcaaaaatgaggagaaggcatataaagaaactcaagagacccaggaaagagacactttgaacaaagaccatggaaatgataaggaatcaaatgttctgcatcagtaattttaataaagaaaagcatgctctgagaga

SEQ ID NO: 357176 - DNA, 1377 bp, Homo sapiens
tttttttcagtgttacattaaaaagacgtttatgaaagcaatttataaagccctagtgggagaccgagattggtgttaatgtaactggagtaagggctgctccgattgctgcagaaattcgacattagccttcaccgcacctgcggagcagcgggagccaggtgagcagcaatttcccctcagggacttcctccgcgttctccgcattttctgtcggcggaactgaatcccaacagtagaaaaacgtggctccgcccatcacctttcctttaaaggacgcggggtgaagccccgcccactacggagagcgaaggggactcgccgcagatccgctgtacttgcgtccgctacagtatgtcaatcgcttgccccagcacagctgtcattcttctctacagaagagcttctcctcatcaactggggatgattacagttcttcctaaaaaagcctacttgatgtgaagacaatgaggatgaagacctttatggtgatccacttccacttaatagatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttgagcaaaaatgaggagaaggcatataaagaaactcaagagacccaggaaagagacactttgaacaaagaccatggaaatgataaggaatcaaatgttctgcatcagtaattttaataaagaaaagcatgctctgagaga

SEQ ID NO: 357177 - DNA, 1244 bp, Homo sapiens
tttttttcagtgttacattaaaaagacgtttatgaaagcaatttataaagccctagtgggagaccgagattggtgttaatgtaactggagtaagggctgctccgattgctgcagaaattcgacattagccttcaccgcacctgcggagcagcgggagccaggtgagcagcaatttcccctcagggacttcctccgcgttctccgcattttctgtcggcggaactgaatcccaacagtagaaaaacgtggctccgcccatcacctttcctttaaaggacgcggggtgaagccccgcccactacggagagcgaaggggactcgccgcagatccgctgtacttgcgtccgctacagtatgtcaatcgcttgccccagcacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaaatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttgagcaaaaatgaggagaaggcatataaagaaactcaagagacccaggaaagagacactttgaacaaagaccatggaaatgataaggaatcaaatgttctgcatcagtaattttaataaagaaaagcatgctctgagaga

SEQ ID NO: 357178 - DNA, 1280 bp, Homo sapiens
cgcagtacgtcgctacgtcccgtctctagccctggcgctccgccggtcccgttctgcaggtgggcgtcgccgccgacttaccaacaaccgggtcgggggctcccggaagtgctcttgcggcttactgcctggcacagtgggctccgtggcttaagacttgaaccaagtaaacgaagttctcttactgagaagtctcagtttcaactgtcattcttctctacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggtaggtattttgctgttggctccctgaatcctttaagagctacaaatcagcagtttaaattctagcatttgtcaaggtgcctgtgacaagagggaaatgagaaactagaaaattcatgattcaaccaccattcccagtgtctgtctttcctcctttatcctgcacttactcctgttccctttttttcactgtttttccacaataccctgcccattatctcttccctttaaacctgtgtaaaatgtgggagaaaccaggcaaacaaaccaaagtgaagagaactctttcccctgtcctgtggccttctcccaatgccgcagcaagctgtagtagccgatggggtgaaacagagtgagattaggaggggtacattcaagttccctgccctctgccgggccactcatttaacctccctccttttgtttttcttccccttcttcaactctaaagtggaggtgtttggttaattatctggaagcacctttttatttttttgagatgagtcactgcactccagcctgggtgacagagcaagactccgtctca

SEQ ID NO: 357179 - DNA, 376 bp, Homo sapiens
ctccgtggcttaagacttgaaccaagtaaacgaagttctcttactgagaagtctcagtttcaagtacgtgttgtgaaaggcctaagtcttagaaaagtagaggatggagagaagaatctgaaaatcgactactattcattctgtcaggcacaacacagtaacgaataagtccattttgttcctgcttcgtagagtttacggtctagtgatggagaacagcagtgctaagatcatcacaaaactgtaattgtaatgaatgttttaaaggaaaggtcaactggactgtagaagcattcagtgttaagctcagtaaattgggggagggatgggagaactggcttagtttggaaggtaatcagaagaatgcgctaaggat

SEQ ID NO: 357180 - DNA, 1316 bp, Homo sapiens
tttttttcagtgttacattaaaaagacgtttatgaaagcaatttataaagccctagtgggagaccgagattggtgttaatgtaactggagtaagggctgctccgattgctgcagaaattcgacattagccttcaccgcacctgcggagcagcgggagccaggtgagcagcaatttcccctcagggacttcctccgcgttctccgcattttctgtcggcggaactgaatcccaacagtagaaaaacgtggctccgcccatcacctttcctttaaaggacgcggggtgaagccccgcccactacggagagcgaaggggactcgccgcagatccgctgtacttgcgtccgctacagtatgtcaatcgcttgccccagcacagctgtcattcttctctacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttgagcaaaaatgaggagaaggcatataaagaaactcaagagacccaggaaagagacactttgaacaaagaccatggaaatgataaggaatcaaatgttctgcatcagtaattttaataaagaaaagcatgctctgagaga

SEQ ID NO: 357181 - DNA, 943 bp, Homo sapiens
  misc_feature (767)..(767): n is a, c, g, or t
  misc_feature (771)..(771): n is a, c, g, or t
  misc_feature (786)..(786): n is a, c, g, or t
  misc_feature (806)..(806): n is a, c, g, or t
cgcagtacgtcgctacgtcccgtctctagccctggcgctccgccggtcccgttctgcagctgtcattcttctctacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggggaatatttattcaaatantccngaattggctggatantaatttcatttaggacaagngtcagggggaaagctttagtgtgtctccgggcttgggcacaaggggagaggtttgaaaccgagacccggaaaccttgacacttgtgtggcacagttcgccgtttaaaaacgcgcgaaaaaaatcggggggcagggat

SEQ ID NO: 357182 - DNA, 1074 bp, Homo sapiens
cgcagtacgtcgctacgtcccgtctctagccctggcgctccgccggtcccgttctgcaggtgggcgtcgccgccgacttaccaacaaccgggtcgggggctcccggaagtgctcttgcggcttactgcctggcacagctgtcattcttctctacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttgagcaaaaatgaggagaaggcatataaagaaactcaagagacccaggaaagagacactttgaacaaagaccatggaaatgataaggaatcaaatgttctgcatcagtaattttaataaagaaaagcatgctctgagaga

SEQ ID NO: 357183 - DNA, 996 bp, Homo sapiens
cgcagtacgtcgctacgtcccgtctctagccctggcgctccgccggtcccgttctgcagctgtcattcttctctacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttgagcaaaaatgaggagaaggcatataaagaaactcaagagacccaggaaagagacactttgaacaaagaccatggaaatgataaggaatcaaatgttctgcatcagtaattttaataaagaaaagcatgctctgagaga

SEQ ID NO: 357184 - DNA, 1793 bp, Homo sapiens
tttttttcagtgttacattaaaaagacgtttatgaaagcaatttataaagccctagtgggagaccgagattggtgttaatgtaactggagtaagggctgctccgattgctgcagaaattcgacattagccttcaccgcacctgcggagcagcgggagccaggtgagcagcaatttcccctcagggacttcctccgcgttctccgcattttctgtcggcggaactgaatcccaacagtagaaaaacgtggctccgcccatcacctttcctttaaaggacgcggggtgaagccccgcccactacggagagcgaaggggactcgccgcagatccgctgtacttgcgtccgctacagtatgtcaatcgcttgccccagcacagctgtcattcttctctacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatgcaaaaatgaggagaaggcatataaagaaactcaagagacccaggaaagagacactttgaacaaagaccatggaaatgataaggaatcaaatgttctgcatcagtaattttaataaagaaaagcatgctctgagagaaaaaaaagctcgctccttggtctgcagtcctttaaacaaagcagtgcagttcttagccaagggtaagtactgcaactgtcgagagcatcttgtcttccacacagttgggtgactctccgttttgacacaaagataagccttgcccttgtttccttttgggagggatatatccactgagatgagaggccaaactccgtttttcacgagattttttgactttgagcttcattttcttcttgtcaggatcatgtacaacagcatgcctagtgagactttgtttcattgcaaatgttttgccacagccagcatgttcacacacaaaagggcggctttcctcatggaaggagaggatatggctttggagattaaacacagttgtataggttcttccacagccttctcttggacagcgacataatcccttctggggcatgagtttatgtgttgcttaaggaacttgcgttaaagttttccggcaacttcacatggattcctttgaatgagttcaaatgttcccatgctaagctgagtctgtgccatagcaaaccatgatatagcaagtctccagaatgtgtacgaatcaatactcc

SEQ ID NO: 357185 - DNA, 1038 bp, Homo sapiens
cgcagtacgtcgctacgtcccgtctctagccctggcgctccgccggtcccgttctgcagaagagcttctcctcatcaactggggatgattacagttcttcctaaaaaagcctacttgatgtgaagacaatgaggatgaagacctttatggtgatccacttccacttaatagatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttgagcaaaaatgaggagaaggcatataaagaaactcaagagacccaggaaagagacactttgaacaaagaccatggaaatgataaggaatcaaatgttctgcatcagtaattttaataaagaaaagcatgctctgagaga

SEQ ID NO: 357186 - DNA, 1455 bp, Homo sapiens
tttttttcagtgttacattaaaaagacgtttatgaaagcaatttataaagccctagtgggagaccgagattggtgttaatgtaactggagtaagggctgctccgattgctgcagaaattcgacattagccttcaccgcacctgcggagcagcgggagccaggtgagcagcaatttcccctcagggacttcctccgcgttctccgcattttctgtcggcggaactgaatcccaacagtagaaaaacgtggctccgcccatcacctttcctttaaaggacgcggggtgaagccccgcccactacggagagcgaaggggactcgccgcagatccgctgtacttgcgtccgctacagtatgtcaatcgcttgccccagcacagctgtcattcttctctacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggtaggtattttgctgttggctccctgaatcctttaagagctacaaatcagcagtttaaattctagcatttgtcaaggtgcctgtgacaagagggaaatgagaaactagaaaattcatgattcaaccaccattcccagtgtctgtctttcctcctttatcctgcacttactcctgttccctttttttcactgtttttccacaataccctgcccattatctcttccctttaaacctgtgtaaaatgtgggagaaaccaggcaaacaaaccaaagtgaagagaactctttcccctgtcctgtggccttctcccaatgccgcagcaagctgtagtagccgatggggtgaaacagagtgagattaggaggggtacattcaagttccctgccctctgccgggccactcatttaacctccctccttttgtttttcttccccttcttcaactctaaagtggaggtgtttggttaattatctggaagcacctttttatttttttgagatgagtcactgcactccagcctgggtgacagagcaagactccgtctca

SEQ ID NO: 357187 - DNA, 2898 bp, Homo sapiens
  misc_feature (21)..(21): n is a, c, g, or t
ggacagggagctgaagacgcngaggtggtggctgcggcctttgaacaagtaagtgagccaccctcggagacccccgcgctggggacgggaggccggcgagcctcgggacctctgaaagccttgaggaggcgcggggacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctg

SEQ ID NO: 357188 - DNA, 4668 bp, Homo sapiens
gagttttatggtatgttattaaaagttgtttaaaagtgagggacccctccagttattgatatggaatgatcttcaggaaaagagcataatatgctacatttttgtacaccaaaggggaggtaggtacgaatatgcatacatattgcttttttctagaagccgcctaggagtgaaaccaaaattcttcacttcttttcggccctacctcgagctccctttagaaaacctttccttccagctcacagtatccaccatgtccaccttcgcctcccggcactgagccttagaggggcggtgctccataaacatttgctacatgaatgaacgaatcaactatcggattttggggtgggtcgggacagctcggttccagcgagggctccgcccacccgcgggctccgcagaggagcagaggttgggcggccgcctcggttaactccgctgcagcccaaagcacgggaatcgcgggacagacaaacgagcggagggaagatacctagaagccaggaaaccgcgagctgcagtccaacttggccggaagctgcggagaggctcagccaccggaagtcagtggagggttcggccggacgctctagaatcccggaggaccgggatctctgtggttggccgtgacgggcaccctctaccggggatgacacattcccagagctcctgggaccaagcaaatggcggacacaattccctgggcggaaggggacttcgggagccagtagccaagacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctgactccaggtgtaatttttggagttcggggtaggacaccatcagcaggggagcaaggaggagccaggtgcctacatttgggggataaacaaatatgtttgtgtgtatgaagccagttcattcaggttctgaaggtttattgagaccttcagtccctacccactcccagccctgcagagattgtcctctgctccctcatgtggctaaacctctcaacacccagagggtatggggaagacctcatatgcatgcctaccttggctgtggctgtttcagggtggtgtgcggtagctgtgttcttggcatagagcttcaggggctgggatgggccatcaggggaagctgagtatgatagtgaggtgggctggggttccacggtactcaccacaggggagtaagttggtgggagggatgctgaagatgggacatggtttgagagcagcccagaggagtgctgggctgtggcctagaatacaccatgggccctgttcacactgcactgctcagcttagcacactagggtggcccagacaggggtccacagtgaggaagcaggacaagatggaccacaaaggcctgcagctgggagagtggctcctggctgtcagctgttgggacagggtggaggcaactcattctcatggagcccagccaggtccaggctagaaccatgtgcctctcggaagaggcctggggaactgctggcagtgtaacttcaggtgtaggggagccgggtctggcttaggaatggatgccctgggtgtgtgacagggatgtggcatggctgagagccacaaggcccccttgtaaggagttggtgctcgggaatcagcagaagcatgcatcaggggcagcagagggagcactcatggagaccatgggtgtccaggggaggaaaggtgcctgagggggccagcccttcaggcccggcggattttcatctcagtgcgtttgagggagtagtagaagcccttccactgggcccagttgatgccattggcataagagaggtgggagccacctaggtagaagccattgaggttggcaaagtggcagctgcggaaccagaaggctcctgaggagagagctgcgcagttctgcacaaagaggtcctggtcccggtcgaaggtagagaacttctggccactgtggtaggacaggga

SEQ ID NO: 357189 - DNA, 3574 bp, Homo sapiens
  misc_feature (21)..(21): n is a, c, g, or t
ggacagggagctgaagacgcngaggtggtggctgcggcctttgaacaactacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctgactccaggtgtaatttttggagttcggggtaggacaccatcagcaggggagcaaggaggagccaggtgcctacatttgggggataaacaaatatgtttgtgtgtatgaagccagttcattcaggttctgaaggtttattgagaccttcagtccctacccactcccagccctgcagagattgtcctctgctccctcatgtggctaaacctctcaacacccagagggtatggggaagacctcatatgcatgcctaccttggctgtggctgtttcagggtggtgtgcggtagctgtgttcttggcatagagcttcaggggctgggatgggccatcaggggaagctgagtatgatagtgaggtgggctggggttccacggtactcaccacaggggagtaagttggtgggagggatgctgaagatgggacatggtttgagagcagcccagaggagtgctgggctgtggcctagaatacaccatgggccctgttcacactgcactgctcagcttagcacactagggtggcccagacaggggtccacagtgaggaagcaggacaagatggaccacaaaggcctgcagctgggagagtggctcctggctgtcagctgttgggacagggtggaggcaactcattctcatggagcccagccaggtccaggctagaaccatgtgcctctcggaagaggcctggggaactgctggcagtgtaacttcaggtgtaggggagccgggtctggcttaggaatggatgccctgggtgtgtgacagggatgtggcatggctgagagccacaaggcccccttgtaaggagttggtgctcgggaatcagcagaagcatgcatcaggggcagcagagggagcactcatggagaccatgggtgtccaggggaggaaaggtgcctgagggggccagcccttcaggcccggcggattttcatctcagtgcgtttgagggagtagtagaagcccttccactgggcccagttgatgccattggcataagagaggtgggagccacctaggtagaagccattgaggttggcaaagtggcagctgcggaaccagaaggctcctgaggagagagctgcgcagttctgcacaaagaggtcctggtcccggtcgaaggtagagaacttctggccactgtggtaggacaggga

SEQ ID NO: 357190 - DNA, 2929 bp, Homo sapiens
  misc_feature (21)..(21): n is a, c, g, or t
  misc_feature (2899)..(2899): n is a, c, g, or t
ggacagggagctgaagacgcngaggtggtggctgcggcctttgaacaagtaagtgagccaccctcggagacccccgcgctggggacgggaggccggcgagcctcgggacctctgaaagccttgaggaggcgcggggacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgnaaaaaaaaaaaaaaaaacaagaaaaaaaaa

SEQ ID NO: 357191 - DNA, 751 bp, Homo sapiens
cctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagaggtgccttgtgggcaggtcgggtgggcagaggggagacttggacttggacaaggcttcaggcttttaccttctcccctgcccaacttccccgcagatggccccagcgcacccctggaggctcctgagcctcggaagccggtgacagcccaggagcgccagc

SEQ ID NO: 357192 - DNA, 3098 bp, Homo sapiens
gagttttatggtatgttattaaaagttgtttaaaagtgagggacccctccagttattgatatggaatgatcttcaggaaaagagcataatatgctacatttttgtacaccaaaggggaggtaggtacgaatatgcatacatattgcttttttctagaagccgcctaggagtgaaaccaaaattcttcacttcttttcggccctacctcgagctccctttagaaaacctttccttccagctcacagtatccaccatgtccaccttcgcctcccggcactgagccttagaggggcggtgctccataaacatttgctacatgaatgaacgaatcaactatcggattttggggtgggtcgggacagctcggttccagcgagggctccgcccacccgcgggctccgcagaggagcagaggttgggcggccgcctcggttaactccgctgcagcccaaagcacgggaatcgcgggacagacaaacgagcggagggaagatacctagaagccaggaaaccgcgagctgcagtccaacttggccggaagctgcggagaggctcagccaccggaagtcagtggagggttcggccggacgctctagaatcccggaggaccgggatctctgtggttggccgtgacgggcaccctctaccggggatgacacattcccagagctcctgggaccaagcaaatggcggacacaattccctgggcggaaggggacttcgggagccagtagccaagctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctg

SEQ ID NO: 357193 - DNA, 2810 bp, Homo sapiens
  misc_feature (21)..(21): n is a, c, g, or t
ggacagggagctgaagacgcngaggtggtggctgcggcctttgaacaaacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctg

SEQ ID NO: 357194 - DNA, 4009 bp, Homo sapiens
ctggaaaggcagctgaatctaatctgaagcaggctgggaaaattcccgcagttctaggaccagttctttagagttttgccagggacaactgttattcctcaagaagtgtacagatgattttacagttttatagaatcttagtatataggatgtcaaatgtaggacattcctactatgaccacaccctcctattcccatagcagacttcactaatcaatcacagaacactttcctacagacagtggacaagcctggtcaattttcatcatagttcttcaagctgccactaccaaacaatggagatagccccaaaaggaaacctattggccagccctggtgtagtccaaccccatcttttatctgatggggaaactaggtctggagacaaaagtgatttaaccaagttcatggaaaagtcgtagagaatctaaaacgtgatgctcttcttccataccatgccgtcagcccctatggggtcccaggctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctgactccaggtgtaatttttggagttcggggtaggacaccatcagcaggggagcaaggaggagccaggtgcctacatttgggggataaacaaatatgtttgtgtgtatgaagccagttcattcaggttctgaaggtttattgagaccttcagtccctacccactcccagccctgcagagattgtcctctgctccctcatgtggctaaacctctcaacacccagagggtatggggaagacctcatatgcatgcctaccttggctgtggctgtttcagggtggtgtgcggtagctgtgttcttggcatagagcttcaggggctgggatgggccatcaggggaagctgagtatgatagtgaggtgggctggggttccacggtactcaccacaggggagtaagttggtgggagggatgctgaagatgggacatggtttgagagcagcccagaggagtgctgggctgtggcctagaatacaccatgggccctgttcacactgcactgctcagcttagcacactagggtggcccagacaggggtccacagtgaggaagcaggacaagatggaccacaaaggcctgcagctgggagagtggctcctggctgtcagctgttgggacagggtggaggcaactcattctcatggagcccagccaggtccaggctagaaccatgtgcctctcggaagaggcctggggaactgctggcagtgtaacttcaggtgtaggggagccgggtctggcttaggaatggatgccctgggtgtgtgacagggatgtggcatggctgagagccacaaggcccccttgtaaggagttggtgctcgggaatcagcagaagcatgcatcaggggcagcagagggagcactcatggagaccatgggtgtccaggggaggaaaggtgcctgagggggccagcccttcaggcccggcggattttcatctcagtgcgtttgagggagtagtagaagcccttccactgggcccagttgatgccattggcataagagaggtgggagccacctaggtagaagccattgaggttggcaaagtggcagctgcggaaccagaaggctcctgaggagagagctgcgcagttctgcacaaagaggtcctggtcccggtcgaaggtagagaacttctggccactgtggtaggacaggga

SEQ ID NO: 357195 - DNA, 486 bp, Homo sapiens
gtacacaaatgtgtgcatgcacatacacacacacacacatacacacacacacacacattcccctttttaattaaaatgaggaaaacacacttggagagccataatttcattttataagccaagaagctaggactaaattgtggtttttttcacccttctaagttgactttttttcctgcttctctcatgacatagtagtcattttttacttaacgaaaatctgatgtaatgaaatgacattttacaagctttaaatgaagcaaatgtttgaattctctttaagtggccttgttcttttgctttcaaaagtaaaatatgttttgttttgtgttatttagcactgggcgtttcaagtttttaatagctttattgagattttgagagagaattcacatgacatacaagtcacccatttaaattggacaattcaatgattgttagtatattcacaacattgtgcagtcattactactcaattttggagca

SEQ ID NO: 357196 - DNA, 1061 bp, Homo sapiens
tgccatagcaaaataaccctcaggcatctgagcatttggagaaacagcagagcttggattgtagtatttaaatgtcaagggatatgcaagcaaagaaaacataggtctctaagggagtatactgtcatattttaaattcattgcataagcatccaaacatagctctagattttattggtgatcttcatgattttttttataattttgagaataaaaaatatggatactttttttaaaatttagggaataaaaaaatataaggatcctagttctagctgaacattcctcctacccttaaccacctcccatacacactgcaagtggagggctgcccagcttctcgattttcaccctgtgtcagtggggtgaggtgcactcttgacgttggacaaggaagaaatcatgggaccgggggaaccaggaaggaagcttgttcatccgtgggaagattaaactttcattctgagcatatgactgcatcacagctttttgtttctgttcttcttgcagttaagatccttctattctacgtaatattttatggctgcctggctggcatcttcatcggaaccatccaagtgatgctgctcaccatcagtgaatttaagcccacatatcaggaccgagtggccccgccaggtaaaatccacatgaatagcttcatttccttcagagatagcatgggtgtcactttttctattgagaaaaaattctttggaaaattactctataatgtagttttaaagcaaccatgaaaagggaaaagagaaacttctctcggctgcagccagatgtcctacccgcattgcaggcagagctcccacgggttgcagacatcttatttgcccagttctagagtgagggtgaagcgtcctggttcttggccagcctgctacccaccagctatgtgactgtgaacagattgagttctgatgggggcctctgtcttctcatttttcatattctagggtttggttagtgggatcctttccagaccttttcaactctaacagacatttttttacttcttgaggggggctatgactcaggtaaattctttt

SEQ ID NO: 357197 - DNA, 283 bp, Homo sapiens
caagcttttctccagaggagacccccttaggcagtcctgcagtgctgctctgcagcatcgcttctcatctgttgacgcagcaattagctatgctggagagggctgagcaggcacaggcacgcacacccacgtgcatgcccacggacatgcaagcgtgcacacacacgcatgctcatggatatacacacacactcaggctaccaagccctggccctgatttgaccctgcttgccttgctgcctgcccagtggtgtaatggaaaagtctcttcttcacatccgcc

SEQ ID NO: 357198 - DNA, 3006 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacaaaaaaaaaaaaaaaaaaaaaaaaaaaaaaaaaaaaaaaaaaaaaaaaaaaaaaaaaaaaaaaaaaacacacgaacacacaaaaagagagggggg

SEQ ID NO: 357199 - DNA, 3076 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattcctcgtgtgtgattcactcttgtctaaatgtcccaacctgtgacttctttactttccacaccactaattatccaagatcttgaagaagtattaaggaacagagattcttctttagtttgcctagattcacttgtgagaaattggagattgtgccgtctaggc

SEQ ID NO: 357200 - DNA, 3050 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattcctcgtgtgtgattcactcttgtctaaatgtcccaacctgtgacttctttactttccacaccactaattatccaagatcttgaagaagtattaaaaagccctcttctttctgtattacggtgtatacactatacta

SEQ ID NO: 357201 - DNA, 3465 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatattacagtgctcttgttgatcttgtattcagtcaggttaaaacaacggacaataaaagaatgaacacattcctcgtgtgtgattcaccaacctgtgacttctttactttccacaccactaattatccaagatcttgaagaagtattaacctgaaacggagaaacacataatttcttagttcagacaaattttggtcttttccacttaacagagtccaagaggttggtcaggacttcagacactggcataccccttcccaaagacactaaaagttaatcaatcaatcagaggcagagaatcgatgaagctccagtttgaagttccatttaaaaaaatcatcttgcagtgctactgctacttcactcagtttagaaaacatgaagtgttggttcctgctattgcttcactagacatatgtgttaaaaaaaaaagttgttagcacttcagtttttaaaaaatgaggttaggtttgtggttcagtaaattaaggttcataccttgctttttggttcagggattggcctaagtccttatttagctgtatttaaaaattagccttagtgtgaaagaagataaaaaagctttccaaaaaacattttccagctataattattaaagatttagtatcacttaactaa

SEQ ID NO: 357202 - DNA, 2913 bp, Homo sapiens
  misc_feature (2553)..(2553): n is a, c, g, or t
  misc_feature (2576)..(2576): n is a, c, g, or t
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtgggttttgggggcctttttcaagggttagagtggcccaatgcggagtgagagctttttaaacaatactctccaatagctcttttcccggggggtggtaaggctctttaatttttaatttttttccctgtgggggcccgggtggggggtttgtgccagtgggggaaacgtgccctttataaattttaaggagggcacacttccaggaaaacccacaaaagggggtgagtgggctgtgggttaagtgcctgtgatattgagaatgtgggtgctcttgtgacaattctctcgtggcccgtggggccccctcgcgggataagtgtcctatanaacgctgtgggtgttccgtgaanatctcgtgggattcgtggcccattacacctgtgggggcctagtgtgacccggggggccctacattttaccgtgggggcgcttataatatccattttgtgcctcttaagctttccctcttgttttcccctttcgcgtgaggaggggcctctacaactgtgccgtgggaggacgggggggatcctctatagtgaaactgtggttttcttaaaccccattttttcccggggggggggagaaagcaaacttcttaatatttttaattgcccggttgttcaccaacttttaattttctttcgcgtgccaagcaaaacacgttggttacgtgtctgttgaaac

SEQ ID NO: 357203 - DNA, 2297 bp, Homo sapiens
gaattcatgctaaattgctggaaggctgcgtctctgctgtggtgtcagttccggatgcctcatcgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacaaaaaaaaaaaaaaaaaaaaaaaaaaaaaaaaaaaaaaaaaaaaaaaaaaaaaaaaaaaaaaaaaaacacacgaacacacaaaaagagagggggg

SEQ ID NO: 357204 - DNA, 2224 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacggtctatgctgctgggtaccggctcgattcgtat

SEQ ID NO: 357205 - DNA, 2231 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacggcgagaagcggcgaagacgagaaccggcgaagggtcgagc

SEQ ID NO: 357206 - DNA, 2073 bp, Homo sapiens
  misc_feature (2013)..(2014): n is a, c, g, or t
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgatcnnatgattgtgttaagcggttctggcctaagtataggggctgggtttaatcaggggagcaa

SEQ ID NO: 357207 - DNA, 3055 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacaaaaaaaaaaaaaaaaaaaaaaaaaaaaaaaaaaaaaaaaaaaaaaaaaaaaaaaaaaaaaaaaaaacacacgaacacacaaaaagagagggggg

SEQ ID NO: 357208 - DNA, 2731 bp, Homo sapiens
  misc_feature (2307)..(2310): n is a, c, g, or t
  misc_feature (2314)..(2323): n is a, c, g, or t
  misc_feature (2359)..(2359): n is a, c, g, or t
  misc_feature (2363)..(2363): n is a, c, g, or t
  misc_feature (2371)..(2371): n is a, c, g, or t
  misc_feature (2398)..(2398): n is a, c, g, or t
  misc_feature (2406)..(2406): n is a, c, g, or t
  misc_feature (2408)..(2408): n is a, c, g, or t
  misc_feature (2413)..(2413): n is a, c, g, or t
  misc_feature (2415)..(2415): n is a, c, g, or t
  misc_feature (2429)..(2429): n is a, c, g, or t
  misc_feature (2431)..(2431): n is a, c, g, or t
  misc_feature (2436)..(2437): n is a, c, g, or t
  misc_feature (2469)..(2469): n is a, c, g, or t
  misc_feature (2485)..(2485): n is a, c, g, or t
  misc_feature (2496)..(2496): n is a, c, g, or t
  misc_feature (2499)..(2499): n is a, c, g, or t
  misc_feature (2548)..(2549): n is a, c, g, or t
  misc_feature (2563)..(2564): n is a, c, g, or t
  misc_feature (2572)..(2572): n is a, c, g, or t
  misc_feature (2594)..(2594): n is a, c, g, or t
  misc_feature (2596)..(2596): n is a, c, g, or t
  misc_feature (2600)..(2600): n is a, c, g, or t
  misc_feature (2602)..(2602): n is a, c, g, or t
  misc_feature (2610)..(2610): n is a, c, g, or t
  misc_feature (2614)..(2614): n is a, c, g, or t
  misc_feature (2620)..(2620): n is a, c, g, or t
  misc_feature (2626)..(2626): n is a, c, g, or t
  misc_feature (2629)..(2629): n is a, c, g, or t
  misc_feature (2635)..(2635): n is a, c, g, or t
  misc_feature (2715)..(2715): n is a, c, g, or t
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacaaaaaaaaaaaaaaaaaaaaaaannnncccnnnnnnnnnnccccccccccccccccaaaaaaaaaaaaaaaaaaantaantaaaaatnttttttttttttttttttttttttttnttttattntntaatntntttttttttttttntntattnnttttataataataatatttatttataatatanatttatttattttaantatatattaanaanaatatttattatatttttttataaaatttaaattttttaattgtatatnnaaaaaaaatatatnnttatttantaaattttatttatatattttntnaatntnaattattntttntttttntataanatntttatntttattatatttttatttatataaaaattttatttttttttttttttttattttttttttaatttttatattttttattntataattttatatttt

SEQ ID NO: 357209 - DNA, 2965 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagtggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacaaaaaaaaaaaaaaaaaaaaaaaaaaaaaaaaaaaaaaaaaaaaaaaaaaaaaaaaaaaaaaaaaaacacacgaacacacaaaaagagagggggg

SEQ ID NO: 357210 - DNA, 1890 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaagttcaaaaaaaactatagttgaaaaatgcatagttggactaaatatctaatgttaattagttgctttaaggtaatggattaaggggcatgcacaat

SEQ ID NO: 357211 - DNA, 1517 bp, Homo sapiens
  misc_feature (1492)..(1492): n is a, c, g, or t
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagactttcgnattcggtaccgagctcgattcgata

SEQ ID NO: 357212 - DNA, 1469 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaaggcaagtaatattttaaatgatagatttagatgagtcatttacactaagtacttaattgatctgaga

SEQ ID NO: 357213 - DNA, 1484 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggtaaaatccacatgaatagcttcatttccttcagagatagcatgggtgtcactttttctattgagaaaaaattctttggaaaattactctataatgtagttttaaagcaaccatgaaaagggaaaagagaaacttctctcggctgcagccagatgtcctacccgcattgcaggcagagctcccacgggttgcagacatcttatttgcccagttctagagtgagggtgaagcgtcctggttcttggccagcctgctacccaccagctatgtgactgtgaacagattgagttctgatgggggcctctgtcttctcatttttcatattctagggtttggttagtgggatcctttccagaccttttcaactctaacagacatttttttacttcttgaggggggctatgactcaggtaaattctttt

SEQ ID NO: 357214 - DNA, 977 bp, Homo sapiens
  misc_feature (24)..(24): n is a, c, g, or t
  misc_feature (191)..(191): n is a, c, g, or t
  misc_feature (197)..(198): n is a, c, g, or t
aggctgtgaagagcgactgggtgncagcagcacctgaagagcctgtgtgaacgtactgtccttgggccgcctggcagttagccatagcccgcttcatgaaagcttcctgggttgccttcttgtttgcagccttgccaccccaggcagccaatgcactggcctggagggctcttccatatgaaaacgcttangctctnncgaattcggcacgagaaaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattcctcgtgtgtgattcactcttgtctaaatgtcccaacctgtgacttctttactttccacaccactaattatccaagatcttgaagaagtattaacctgaaacggagaaacacataatttcttagttcagacaaattttggtcttttccacttaacagagtccaagaggttggtcaggacttcagacactggcataccccttcccaaagacactaaaagttaatcaatcaatcagaggcagagaatcgatgaagctccagtttgaagttccatttaaaaaaatcatcttgcagtgctactgctacttcactcagtttagaaaacatgaagtgttggttcctgctattgcttcactagacatatgtgttaaaaaaaaaagttgttagcacttcagtttttaaaaaatgaggttaggtttgtggttcagtaaattaaggttcataccttgctttttggttcagggattggcctaagtccttatttagctgtatttaaaaattagccttagtgtgaaagaagataaaaaagctttccaaaaaacattttccagctataattattaaagatttagtatcacttaactaa

SEQ ID NO: 357215 - DNA, 340 bp, Homo sapiens
atgatagatttagatgagtcatttacactaagtacttaattgatctgagaagacaatgtaagatagttttaaagtatactcagtgctgactttgaaacgtagccagtagagtaacaccaaaaacttctgtatccaccctgcaattcttgtagttaggacattaatctcattttctaaagttaaaggaattctgagaggcaaagctgcattctgaagtgagtctgtggcccttttcttaatactcctgctcagtatccagataacagtttctataacataaactctttaaaaaagtaaaaatggaaaaatatattttttccctggtggtctagtggttaga

SEQ ID NO: 357216 - DNA, 231 bp, Homo sapiens
cagaagactgaaatttcctttcgtcctaatgatcccaagagctatgaggcatatgtactgaacatagttaggttcctggaaaagtacaaagattcagcccagagggatgacatgatttttgaagattgtggcggtaagtagactcattgtagatgtctgtggctagttttctttctctttaactcttatttcccacttctattttttgtttaatgatcgagagataatcct

SEQ ID NO: 357217 - DNA, 411 bp, Homo sapiens
acatgcaagcgtgcacacacacgcatgctcatggatatacacacacactcaggctaccaagccctggccctgatttgaccctgcttgccttgctgcctgcccagtggtgtaatggaaaagtctcttcttcacatccgccattgcccttcccccacctcaggctcacttagcaacagtggagtgaaatgaaggtcactgtgtgtcaatcggtgggtccgggagattcccagctggcttgcttcctggtaggcaggtatgaatgtatgctgctgttctctcttttaaggttgtgggtggctgtttgtttagctctgaagtatagacggctcagtgctagcagacacattttcaaagggtcatattcttggcttgttggtaatcagaatcgggcaggagaagtggggtggatgc

SEQ ID NO: 357218 - DNA, 1015 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctcggaggactactcccatacccgagcgtgccgagatctcgggcgcgagaccggacccttccccctcatcctgctgccccagctctggcgcgccctgcccattgagggcaccacacgactcccagcatcccccaccaccaccccacttagcactcgcccacaacccaaggtgaaagcctcgactgacaaccccaacaacccgccctctaccggaagcctttctccgccggaccactcccaattctactcctggacactgccctcgcaccacctctgcctcctccctcacgtaccatgtctcggcggcaccacagcacctgcgcgctgctgctcccggacccacgtgccgcgcgataccatgatgtcctcccccctctgcactccgactaccctctgcagcca

SEQ ID NO: 357219 - DNA, 3359 bp, Homo sapiens
  misc_feature (2935)..(2938): n is a, c, g, or t
  misc_feature (2942)..(2951): n is a, c, g, or t
  misc_feature (2987)..(2987): n is a, c, g, or t
  misc_feature (2991)..(2991): n is a, c, g, or t
  misc_feature (2999)..(2999): n is a, c, g, or t
  misc_feature (3026)..(3026): n is a, c, g, or t
  misc_feature (3034)..(3034): n is a, c, g, or t
  misc_feature (3036)..(3036): n is a, c, g, or t
  misc_feature (3041)..(3041): n is a, c, g, or t
  misc_feature (3043)..(3043): n is a, c, g, or t
  misc_feature (3057)..(3057): n is a, c, g, or t
  misc_feature (3059)..(3059): n is a, c, g, or t
  misc_feature (3064)..(3065): n is a, c, g, or t
  misc_feature (3097)..(3097): n is a, c, g, or t
  misc_feature (3113)..(3113): n is a, c, g, or t
  misc_feature (3124)..(3124): n is a, c, g, or t
  misc_feature (3127)..(3127): n is a, c, g, or t
  misc_feature (3176)..(3177): n is a, c, g, or t
  misc_feature (3191)..(3192): n is a, c, g, or t
  misc_feature (3200)..(3200): n is a, c, g, or t
  misc_feature (3222)..(3222): n is a, c, g, or t
  misc_feature (3224)..(3224): n is a, c, g, or t
  misc_feature (3228)..(3228): n is a, c, g, or t
  misc_feature (3230)..(3230): n is a, c, g, or t
  misc_feature (3238)..(3238): n is a, c, g, or t
  misc_feature (3242)..(3242): n is a, c, g, or t
  misc_feature (3248)..(3248): n is a, c, g, or t
  misc_feature (3254)..(3254): n is a, c, g, or t
  misc_feature (3257)..(3257): n is a, c, g, or t
  misc_feature (3263)..(3263): n is a, c, g, or t
  misc_feature (3343)..(3343): n is a, c, g, or t
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacaaaaaaaaaaaaaaaaaaaaaaannnncccnnnnnnnnnnccccccccccccccccaaaaaaaaaaaaaaaaaaantaantaaaaatnttttttttttttttttttttttttttnttttattntntaatntntttttttttttttntntattnnttttataataataatatttatttataatatanatttatttattttaantatatattaanaanaatatttattatatttttttataaaatttaaattttttaattgtatatnnaaaaaaaatatatnnttatttantaaattttatttatatattttntnaatntnaattattntttntttttntataanatntttatntttattatatttttatttatataaaaattttatttttttttttttttttattttttttttaatttttatattttttattntataattttatatttt

SEQ ID NO: 357220 - DNA, 3498 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattcctcgtgtgtgattcactcttgtctaaatgtcccaacctgtgacttctttactttccacaccactaattatccaagatcttgaagaagtattaacctgaaacggagaaacacataatttcttagttcagacaaattttggtcttttccacttaacagagtccaagaggttggtcaggacttcagacactggcataccccttcccaaagacactaaaagttaatcaatcaatcagaggcagagaatcgatgaagctccagtttgaagttccatttaaaaaaatcatcttgcagtgctactgctacttcactcagtttagaaaacatgaagtgttggttcctgctattgcttcactagacatatgtgttaaaaaaaaaagttgttagcacttcagtttttaaaaaatgaggttaggtttgtggttcagtaaattaaggttcataccttgctttttggttcagggattggcctaagtccttatttagctgtatttaaaaattagccttagtgtgaaagaagataaaaaagctttccaaaaaacattttccagctataattattaaagatttagtatcacttaactaa

SEQ ID NO: 357221 - DNA, 3051 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattcctcgtgtgtgattcactcttgtctaaatgtcccaacctgtgacttctttactttccacaccactaattatccaagatcttgaagaagtattaacaacaagcctctctttttttaattacgtgcatattgttgtgat

SEQ ID NO: 357222 - DNA, 3066 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattcctcgtgtgtgattcactcttgtctaaatgtcccaacctgtgacttctttactttccacaccactaattatccaagatcttgaagaagtattaataaagccccctctttcttcccctctcttctcgcttcgtcgctcctatcactaatcttc

SEQ ID NO: 357223 - DNA, 3053 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattcctcgtgtgtgattcactcttgtctaaatgtcccaacctgtgacttctttactttccacaccactaattatccaagatcttgaagaagtattaatagaccccttctctgcccataaatagtcgaccaggtttcatatca

SEQ ID NO: 357224 - DNA, 3466 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtagtgcaaaatccatgttctaacatatgtaataattgccaggagtacagtgctcttgttgatcttgtattcagtcaggttaaaaaatgaacacattcctcgtgtgtgattcactcttgtctaaatgtcccaacctgtgacttctttactttccacaccactaattatccaagatcttgaagaagtattaacctgaaacggagaaacacataatttcttagttcagacaaattttggtcttttccacttaacagagtccaagaggttggtcaggacttcagacactggcataccccttcccaaagacactaaaagttaatcaatcaatcagaggcagagaatcgatgaagctccagtttgaagttccatttaaaaaaatcatcttgcagtgctactgctacttcactcagtttagaaaacatgaagtgttggttcctgctattgcttcactagacatatgtgttaaaaaaaaaagttgttagcacttcagtttttaaaaaatgaggttaggtttgtggttcagtaaattaaggttcataccttgctttttggttcagggattggcctaagtccttatttagctgtatttaaaaattagccttagtgtgaaagaagataaaaaagctttccaaaaaacattttccagctataattattaaagatttagtatcacttaactaa

SEQ ID NO: 357225 - DNA, 2541 bp, Homo sapiens
  misc_feature (2234)..(2235): n is a, c, g, or t
  misc_feature (2240)..(2242): n is a, c, g, or t
  misc_feature (2249)..(2249): n is a, c, g, or t
  misc_feature (2253)..(2253): n is a, c, g, or t
  misc_feature (2256)..(2256): n is a, c, g, or t
  misc_feature (2262)..(2263): n is a, c, g, or t
  misc_feature (2270)..(2270): n is a, c, g, or t
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtaaaaagggnnggggnnnttcaaanggtnatnggcccnngatgaanctttttaaaatcaccaaaggactttgaccggggggaagggctacaattaaattaacccgcggggccggggggagggttgaaggggaagcccttacattagtggacctcagaaaccacaaagggggtgtatgttgtctggatgggtggaatgtggggccgatttaaacgggtgaacggtgccaccatggagaagcaaaggtaaacataaactattggagaagggttagagacatggaattggcctttcactgaacgtattaagagtcttcat

SEQ ID NO: 357226 - DNA, 2417 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgtccccgtacatcgttagaagcttgaattcgagcagtagtagtagtaggcggccgc

SEQ ID NO: 357227 - DNA, 2877 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtgattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacaaaaaaaaaaaaaaaaaaaaaaaaaaaaaaaaaaaaaaaaaaaaaaaaaaaaaaaaaaaaaaaaaaacacacgaacacacaaaaagagagggggg

SEQ ID NO: 357228 - DNA, 2956 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaaatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacaaaaaaaaaaaaaaaaaaaaaaaaaaaaaaaaaaaaaaaaaaaaaaaaaaaaaaaaaaaaaaaaaaacacacgaacacacaaaaagagagggggg

SEQ ID NO: 357229 - DNA, 1894 bp, Homo sapiens
ccggttaagagctgatcacaagcacaaatctttcccactagccatttaataagttagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacaaaaaaaaaaaaaaaaaaaaaaaaaaaaaaaaaaaaaaaaaaaaaaaaaaaaaaaaaaaaaaaaaaacacacgaacacacaaaaagagagggggg

SEQ ID NO: 357230 - DNA, 1702 bp, Homo sapiens
ctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagcggaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccggccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgcacatcacatcggtgccgagctcgattgtacc

SEQ ID NO: 357231 - DNA, 1582 bp, Homo sapiens
acatgatacaattcagctcggtacctgaacattcgtgtcccccgttcagtgcactggcagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttgtttgttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacaaaaaaaaaaaaaaaaaaaaaaaaaaaaaaaaaaaaaaaaaaaaaaaaaaaaaaaaaaaaaaaaaaacacacgaacacacaaaaagagagggggg

SEQ ID NO: 357232 - DNA, 2830 bp, Homo sapiens
gagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaaaaatcagaaaacccccacctaatccacagaaagtaatgtctttcccctccccttggaatttttgttttgtttttggaaataatatttttttaaaagttgccttattgtggagcgggaatctgaaatacccaaatgcctgttttcctcggtggagtcaacccgaagagctcccaccttctctggatgtgcctgggcttggactggctagaatctttctctggactgttgcatgtacagtgcctccatcctggaggcaagagagttgggagtggctcgaatcagagccgtgcccaagatatccctgctgttgcatcgtttgaagctgacgtcctgtgtctgtacactgctgccactgttgtgtcctcgctctgcttgctgttgcctcacgccaggccccgtcctgccgtgacacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgtgcccttccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggccagggggctgccatcttcttcacagacatccctgaaaggaagcccctttggggcagggaggtgaggacttcatctcaacatcggctggtggttggtaggggagctttttcttttctttcctttttttttgtttttgtttttgtttttgtttttggtaacatgttaggagttaatgttgcaaagagtagtttacatcttcactttctgaagacacttgaatttaggaccgatgtatctgtgacaagcatgccagaagtggcaggggccatcagggctaaccacttcacacctaccatcgtcccatggggatccaagacctgagataaagcaacagcctgcccagatccctctgttcatcctatcccttccaaggttggtccatgccaacataacctctgggcatcagacatcagcaggtctgtgtgcctcagccctgttaaggggcaggtttctctttagccctcttcctgcacttgggagcaaaggcactaccagtagagaagggccatccagccgtgccccagcctggacccctggggctcagatagaggtgctgagcccctgtgtcaaagttgttaaatgtttttgttttgttccattgtagctcttttttttttttttttccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaa

SEQ ID NO: 357233 - DNA, 405 bp, Homo sapiens
ttatcttctctgccatcagcatggctgaagggggagagggtgggtgttagggaaaatccaggacccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaa

SEQ ID NO: 357234 - DNA, 287 bp, Homo sapiens
tgacctgaacttaatgagaagacatccacggagcgcatattacagaatgctggttgcctcaggtgttgttaacgtacttgtagtccgcgcattttatcccattgaaatccagctgtgagctttttacatgagcacccaccctctcccccttcagccatgctgatggcagagaagataagaacttggagctttgaagatttctatgttaggaaaagccaaactaaatatactggctctgcttgtatttcttaaatgacaaagattacctagctaagaaacttccgagg

SEQ ID NO: 357235 - DNA, 2990 bp, Homo sapiens
gagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaaaaatcagaaaacccccacctaatccacagaaagtaatgtctttcccctccccttggaatttttgttttgtttttggaaataatatttttttaaaagttgccttattgtggagcgggaatctgaaatacccaaatgcctgttttcctcggtggagtcaacccgaagagctcccaccttctctggatgtgcctgggcttggactggctagaatctttctctggactgttgcatgtacagtgcctccatcctggaggcaagagagttgggagtggctcgaatcagagccgtgcccaagatatccctgctgttgcatcgtttgaagctgacgtcctgtgtctgtacactgctgccactgttgtgtcctcgctctgcttgctgttgcctcacgccaggccccgtcctgccgtgacacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgtgcccttccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggccagggggctgccatcttcttcacagacatccctgaaaggaagcccctttggggcagggaggtgaggacttcatctcaacatcggctggtggttggtaggggagctttttcttttctttcctttttttttgtttttgtttttgtttttgtttttggtaacatgttaggagttaatgttgcaaagagtagtttacatcttcactttctgaagacacttgaatttaggaccgatgtatctgtgacaagcatgccagaagtggcaggggccatcagggctaaccacttcacacctaccatcgtcccatggggatccaagacctgagataaagcaacagcctgcccagatccctctgttcatcctatcccttccaaggttggtccatgccaacataacctctgggcatcagacatcagcaggtctgtgtgcctcagccctgttaaggggcaggtttctctttagccctcttcctgcacttgggagcaaaggcactaccagtagagaagggccatccagccgtgccccagcctggacccctggggctcagatagaggtgctgagcccctgtgtcaaagttgttaaatgtttttgttttgttccattgtagctcttttttttttttttttccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaaaaaaaaaaaaaaaaaaaaaaaaaaaaaaaaaaaaaaaaaaaaaaaaaaaaaaaaaaaaaacctcgagggggggcccgttacccattttgccctttagtgagtcgttttacaattcattggccgtcttttaacaacttcttgactgggaaaaaacctggcg

SEQ ID NO: 357236 - DNA, 3211 bp, Homo sapiens
gagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaaaaatcagaaaacccccacctaatccacagaaagtaatgtctttcccctccccttggaatttttgttttgtttttggaaataatatttttttaaaagttgccttattgtggagcgggaatctgaaatacccaaatgcctgttttcctcggtggagtcaacccgaagagctcccaccttctctggatgtgcctgggcttggactggctagaatctttctctggactgttgcatgtacagtgcctccatcctggaggcaagagagttgggagtggctcgaatcagagccgtgcccaagatatccctgctgttgcatcgtttgaagctgacgtcctgtgtctgtacactgctgccactgttgtgtcctcgctctgcttgctgttgcctcacgccaggccccgtcctgccgtgacacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgtgcccttccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggccagggggctgccatcttcttcacagacatccctgaaaggaagcccctttggggcagggaggtgaggacttcatctcaacatcggctggtggttggtaggggagctttttcttttctttcctttttttttgtttttgtttttgtttttgtttttggtaacatgttaggagttaatgttgcaaagagtagtttacatcttcactttctgaagacacttgaatttaggaccgatgtatctgtgacaagcatgccagaagtggcaggggccatcagggctaaccacttcacacctaccatcgtcccatggggatccaagacctgagataaagcaacagcctgcccagatccctctgttcatcctatcccttccaaggttggtccatgccaacataacctctgggcatcagacatcagcaggtctgtgtgcctcagccctgttaaggggcaggtttctctttagccctcttcctgcacttgggagcaaaggcactaccagtagagaagggccatccagccgtgccccagcctggacccctggggctcagatagaggtgctgagcccctgtgtcaaagttgttaaatgtttttgttttgttccattgtagctcttttttttttttttttccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaaaaaaaaaaaaaaaaaaaaaaaaaaaaaaaaaaaaaaaaagaggggggggcgccccaaaaattccccccgggggggccccttgcccccctttttctgggtcaaaagagggtgcccccaatagggaggaggaggagagtaatataagaacagcagaagacgacgggagcgcggcgcgcgcttataaaccaaacagcggttggcggaacgggaggaaaaacagcggcaacaacgagggggaaaactcttgggggggaaggagaaccacctacttcgtcgcggggggggcgccaccatctggtgggacaaaaacaccccgcagacgaagagaattaaaacgccccaagagggaaaaccatcacacactttgcaggggagtataag

SEQ ID NO: 357237 - DNA, 2776 bp, Homo sapiens
gagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaaaaatcagaaaacccccacctaatccacagaaagtaatgtctttcccctccccttggaatttttgttttgtttttggaaataatatttttttaaaagttgccttattgtggagcgggaatctgaaatacccaaatgcctgttttcctcggtggagtcaacccgaagagctcccaccttctctggatgtgcctgggcttggactggctagaatctttctctggactgttgcatgtacagtgcctccatcctggaggcaagagagttgggagtggctcgaatcagagccgtgcccaagatatccctgctgttgcatcgtttgaagctgacgtcctgtgtctgtacactgctgccactgttgtgtcctcgctctgcttgctgttgcctcacgccaggccccgtcctgccgtgacacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgtgcccttccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggccagggggctgccatcttcttcacagacatccctgaaaggaagcccctttggggcagggaggtgaggacttcatctcaacatcggctggtggttggtaggggagctttttcttttctttcctttttttttgtttttgtttttgtttttgtttttggtaacatgttaggagttaatgttgcaaagagtagtttacatcttcactttctgaagacacttgaatttaggaccgatgtatctgtgacaagcatgccagaagtggcaggggccatcagggctaaccacttcacacctaccatcgtcccatggggatccaagacctgagataaagcaacagcctgcccagatccctctgttcatcctatcccttccaaggttggtccatgccaacataacctctgggcatcagacatcagcaggtctgtgtgcctcagccctgttaaggggcaggtttctctttagccgtgccccagcctggacccctggggctcagatagaggtgctgagcccctgtgtcaaagttgttaaatgtttttgttttgttccattgtagctcttttttttttttttttccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaa

SEQ ID NO: 357238 - DNA, 1724 bp, Homo sapiens
  misc_feature (9)..(9): n is a, c, g, or t
tgtgttaangcatgtgccgttcccaacgcatgtgccgctcccaacgcatgtgcgctcccaacgcatgtgccgctcccaacgcatgtgccgctcccaacgcatgtgccgctcccaacgcatgtgccgctcccaacgcatgtgccgctcccaacgcatgtgccgctcccaacgcatgtgccgctcccaacgcatgtccgctccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggccagggggctgccatcttcttcacagacatccctgaaaggaagcccctttggggcagggaggtgaggacttcatctcaacatcggctggtggttggtaggggagctttttcttttctttcctttttttttgtttttgtttttgtttttgtttttggtaacatgttaggagttaatgttgcaaagagtagtttacatcttcactttctgaagacacttgaatttaggaccgatgtatctgtgacaagcatgccagaagtggcaggggccatcagggctaaccacttcacacctaccatcgtcccatggggatccaagacctgagataaagcaacagcctgcccagatccctctgttcatcctatcccttccaaggttggtccatgccaacataacctctgggcatcagacatcagcaggtctgtgtgcctcagccctgttaaggggcaggtttctctttagccctcttcctgcacttgggagcaaaggcactaccagtagagaagggccatccagccgtgccccagcctggacccctggggctcagatagaggtgctgagcccctgtgtcaaagttgttaaatgtttttgttttgttccattgtagctcttttttttttttttttccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaa

SEQ ID NO: 357239 - DNA, 1372 bp, Homo sapiens
ctgaggatcctcagacagcggaccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggccagggggctgccatcttcttcacagacatccctgaaaggaagcccctttggggcagggaggtgaggacttcatctcaacatcggctggtggttggtaggggagctttttcttttctttcctttttttttgtttttgtttttgtttttgtttttggtaacatgttaggagttaatgttgcaaagagtagtttacatcttcactttctgaagacacttgaatttaggaccgatgtatctgtgacaagcatgccagaagtggcaggggccatcagggctaaccacttcacacctaccatcgtcccatggggatccaagacctgagataaagcaacagcctgcccagatccctctgttcatcctatcccttccaaggttggtccatgccaacataacctctgggcatcagacatcagcaggtctgtgtgcctcagccctgttaaggggcaggtttctctttagccctcttcctgcacttgggagcaaaggcactaccagtagagaagggccatccagccgtgccccagcctggacccctggggctcagatagaggtgctgagcccctgtgtcaaagttgttaaatgtttttgttttgttccattgtagctcttttttttttttttttccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaa

SEQ ID NO: 357240 - DNA, 1977 bp, Homo sapiens
gagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaaaaatcagaaaacccccacctaatccacagaaagtaatgtctttcccctccccttggaatttttgttttgtttttggaaataatatttttttaaaagttgccttattgtggagcgggaatctgaaatacccaaatgcctgttttcctcggtggagtcaacccgaagagctcccaccttctctggatgtgcctgggcttggactggctagaatctttctctggactgttgcatgtacagtgcctccatcctggaggcaagagagttgggagtggctcgaatcagagccgtgcccaagatatccctgctgttgcatcgtttgaagctgacgtcctgtgtctgtacactgctgccactgttgtgtcctcgctctgcttgctgttgcctcacgccaggccccgtcctgccgtgacacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcacgcccagatccctctgttcatcctatcccttccaaggttggtccatgccaacataacctctgggcatcagacatcagcaggtctgtgtgcctcagccctgttaaggggcaggtttctctttagccctcttcctgcacttgggagcaaaggcactaccagtagagaagggccatccagccgtgccccagcctggacccctggggctcagatagaggtgctgagcccctgtgtcaaagttgttaaatgtttttgttttgttccattgtagctcttttttttttttttttccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaa

SEQ ID NO: 357241 - DNA, 1293 bp, Homo sapiens
ggtgttctagaggatcccatctcaggccaggacgatctcaggcccgggactttttttggggacaggtctggtttggtgcccaggctggagcgcacgggcatgttcacggctcactgcagccttgacttcccaggctcaagacatcctcccacctcagcctcttgagtagctgggaccacagggatgtgtcaccaagcctggctttttcttttctttcctttttttttgtttttgtttttgtttttgtttttggtaacatgttaggagttaatgttgcaaagagtagtttacatcttcactttctgaagacacttgaatttaggaccgatgtatctgtgacaagcatgccagaagtggcaggggccatcagggctaaccacttcacacctaccatcgtcccatggggatccaagacctgagataaagcaacagcctgcccagatccctctgttcatcctatcccttccaaggttggtccatgccaacataacctctgggcatcagacatcagcaggtctgtgtgcctcagccctgttaaggggcaggtttctctttagccctcttcctgcacttgggagcaaaggcactaccagtagagaagggccatccagccgtgccccagcctggacccctggggctcagatagaggtgctgagcccctgtgtcaaagttgttaaatgtttttgttttgttccattgtagctcttttttttttttttttccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaa

SEQ ID NO: 357242 - DNA, 2029 bp, Homo sapiens
gagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaaaaatcagaaaacccccacctaatccacagaaagtaatgtctttcccctccccttggaatttttgttttgtttttggaaataatatttttttaaaagttgccttattgtggagcgggaatctgaaatacccaaatgcctgttttcctcggtggagtcaacccgaagagctcccaccttctctggatgtgcctgggcttggactggctagaatctttctctggactgttgcatgtacagtgcctccatcctggaggcaagagagttgggagtggctcgaatcagagccgtgcccaagatatccctgctgttgcatcgtttgaagctgacgtcctgtgtctgtacactgctgccactgttgtgtcctcgctctgcttgctgttgcctcacgccaggccccgtcctgccgtgacacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgtgcccttccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggccagggggctgccatcttcttcacagacatccctgaaaggaagcccctttggggcagggagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaa

SEQ ID NO: 357243 - DNA, 3020 bp, Homo sapiens
gagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaaaaatcagaaaacccccacctaatccacagaaagtaatgtctttcccctccccttggaatttttgttttgtttttggaaataatatttttttaaaagttgccttattgtggagcgggaatctgaaatacccaaatgcctgttttcctcggtggagtcaacccgaagagctcccaccttctctggatgtgcctgggcttggactggctagaatctttctctggactgttgcatgtacagtgcctccatcctggaggcaagagagttgggagtggctcgaatcagagccgtgcccaagatatccctgctgttgcatcgtttgaagctgacgtcctgtgtctgtacactgctgccactgttgtgtcctcgctctgcttgctgttgcctcacgccaggccccgtcctgccgtgacacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgtgcccttccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggccagggggctgccatcttcttcacagacatccctgaaaggaagcccctttggggcagggaggtgaggacttcatctcaacatcggctggtggttggtaggggagctttttcttttctttcctttttttttgtttttgtttttgtttttgtttttggtaacatgttaggagttaatgttgcaaagagtagtttacatcttcactttctgaagacacttgaatttaggaccgatgtatctgtgacaagcatgccagaagtggcaggggccatcagggctaaccacttcacacctaccatcgtcccatggggatccaagacctgagataaagcaacagcctgcccagatccctctgttcatcctatcccttccaaggttggtccatgccaacataacctctgggcatcagacatcagcaggtctgtgtgcctcagccctgttaaggggcaggtttctctttagccctcttcctgcacttgggagcaaaggcactaccagtagagaagggccatccagccgtgccccagcctggacccctggggctcagatagaggtgctgagcccctgtgtcaaagttgttaaatgtttttgttttgttccattgtagctcttttttttttttttttccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaaaaaaaaaaaaaaaaaaaaaaaaaaaaaaaaaaaaaaaaaaaaaaaaaaaaaaaaaaaaaaaaaaaaaaaaagaaaaaaaaaaaaaagagaggggggggcgacagcagatacaacacgacggggaggcccacacacgccccgaccagacatgttgtatacgaagaggggcacactagaggcgggcatatag

SEQ ID NO: 357244 - DNA, 2601 bp, Homo sapiens
gagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaaaaatcagaaaacccccacctaatccacagaaagtaatgtctttcccctccccttggaatttttgttttgtttttggaaataatatttttttaaaagttgccttattgtggagcgggaatctgaaatacccaaatgcctgttttcctcggtggagtcaacccgaagagctcccaccttctctggatgtgcctgggcttggactggctagaatctttctctggactgttgcatgtacagtgcctccatcctggaggcaagagagttgggagtggctcgaatcagagccgtgcccaagatatccctgctgttgcatcgtttgaagctgacgtcctgtgtctgtacactgctgccactgttgtgtcctcgctctgcttgctgttgcctcacgccaggccccgtcctgccgtgacacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgtgcccttccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggccagggggctgccatcttcttcacagacatccctgaaaggaagcccctttggggcagggaggtgaggacttcatctcaacatcggctggtggttggtaggggagctttttcttttctttcctttttttttgtttttgtttttgtttttgtttttggcaacataacctctgggcatcagacatcagcaggtctgtgtgcctcagccctgttaaggggcaggtttctctttagccctcttcctgcacttgggagcaaaggcactaccagtagagaagggccatccagccgtgccccagcctggacccctggggctcagatagaggtgctgagcccctgtgtcaaagttgttaaatgtttttgttttgttccattgtagctcttttttttttttttttccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaa

SEQ ID NO: 357245 - DNA, 2194 bp, Homo sapiens
gagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaaaaatcagaaaacccccacctaatccacagaaagtaatgtctttcccctccccttggaatttttgttttgtttttggaaataatatttttttaaaagttgccttattgtggagcgggaatctgaaatacccaaatgcctgttttcctcggtggagtcaacccgaagagctcccaccttctctggatgtgcctgggcttggactggctagaatctttctctggactgttgcatgtacagtgcctccatcctggaggcaagagagttgggagtggctcgaatcagagccgtgcccaagatatccctgctgttgcatcgtttgaagctgacgtcctgtgtctgtacactgctgccactgttgtgtcctcgctctgcttgctgttgcctcacgccaggccccgtcctgccgtgacacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgtgcccttccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggccagggggctgccatcttcttcacagacatccctgaaaggaagcccctttggggcagggaggtgaggacttcatctcaacatcggctggtggttggtaggggagctttttcttttctttcctttttttttgtttttgtttttgtttttgtttttggtaacatgttaggagttaatgttgcaaagagtagtttacatcttcactttctgaagacacttgaatttaggaccgatgtatctgtgacaagcatgccagaagtggcaggggccatcagggctaaccacttcacacctaccatcgtcccatggggatccaagacctgagataaagcaacagcctgcccagatccctctgttcatcctatcccttccaaggttggtccatgccaacataacctctgggcatcagacatcagcaggtctgtgtgcctcagccctgttaaggggcaggtttctctttagccctcttcctgcacttgggagcgcacatgcgttgggagcggcacatgcgttgggagcggcacatgcgttgggagcgcacatgcgttgggggatcctctag

SEQ ID NO: 357246 - DNA, 726 bp, Homo sapiens
  misc_feature (681)..(681): n is a, c, g, or t
gaaccgtttactcgctgctgtgcccagtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttggggaaaggggtcccccctttttggcccgggcaaaaggggcgggggatatccccaggttggcgaccttggtacctgggagccntcaaattctatagcctcaaagggagacccccggggtttaaacctc

SEQ ID NO: 357247 - DNA, 216 bp, Homo sapiens
tgagacagagtctcgctctgtcacccaggctggagtgcagtggcatgatctcagctcactgtaacctctgcctcctgggttcaagcaatcctcctgtctcaacctcccaagtaggattacaagcatgcgccgacgatgcccagaatccagaactttgtctatcactctccccaacaacctagatgtgaaaacagaataaacttcacccagaaaaca

SEQ ID NO: 357248 - DNA, 1216 bp, Homo sapiens
ttagggcccatcacaggtccccaagggactcccccccaccagccgagagggggaattccccgggcccgaaggtggaaggcctcccgccccgccactcaagaccccgtcacgccggcccgaaactcatgcccgctccaacactccccggctcgccctctgggcttcaaggaactgacaggaggcgctgggcatccagccccgctctcctcgacagaggcttggacccttgccgcagcttgggcccccgggctcgggcgagggcagcgccccgccggagtctcccggctgtgtagtcccggagagccccgggccccgaggggccgaacggccgctacgacggcggcgaatctcgggctcctgacctggcggacccggtagctgggggcgggagaccggcggggagacaacccgaccaggtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaaca

SEQ ID NO: 357249 - DNA, 805 bp, Homo sapiens
gaaccgtttactcgctgctgtgcccagtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcagattgagcggtgcgcaggcagagtgatggaacatgcgcggtaatgagataacagttgactctggacgagctcgggacagtcggtcatcctgagtgttcttggaacggccctgcacccttcattggcccgtctgcgcacggaggtacctcgactagtccgcctcgaggcgtgccccgcagctcgtgcgcgttccatccgtcgcgcccgtgcagtcgtcggccaaactcgcgtgtgctggccgtcgctagaattcaggcttggctcttgcgattccttgaaactggggaggccgtgcagtgccctcgccagttgcggcgcgctaaagtgggtccaacgggcttggccacgaaagcctcgtcgagtggcctagtgcttggccctagtcacgtccggtcccgctacagtacggttctactcatttcgtgttcgcccccttggacttgggagccttatcagtcccaaccccctacctaaatggtaacttcttccgaagtcagctagacgcgaggcgattcgagggcacgttaggcccagacaaagtcttcctccaagaagacgctacttacctttcctttcttgtgggccttaaactcctgccaaggttgggactctcagacacttt

SEQ ID NO: 357250 - DNA, 854 bp, Homo sapiens
gaaccgtttactcgctgctgtgcccagtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggcaggtgagaatgcgggtaaggatgcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaaca

SEQ ID NO: 357251 - DNA, 826 bp, Homo sapiens
gaaccgtttactcgctgctgtgcccagtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaaca

SEQ ID NO: 357252 - DNA, 1433 bp, Homo sapiens
ttagggcccatcacaggtccccaagggactcccccccaccagccgagagggggaattccccgggcccgaaggtggaaggcctcccgccccgccactcaagaccccgtcacgccggcccgaaactcatgcccgctccaacactccccggctcgccctctgggcttcaaggaactgacaggaggcgctgggcatccagccccgctctcctcgacagaggcttggacccttgccgcagcttgggcccccgggctcgggcgagggcagcgccccgccggagtctcccggctgtgtagtcccggagagccccgggccccgaggggccgaacggccgctacgacggcggcgaatctcgggctcctgacctggcggacccggtagctgggggcgggagaccggcggggagacaacccgaccaggtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaacaaaaaaaaaaaaaaaaaaaaaaaaaaaaaaaaaaaaaaaaaaaaaaaaaaaaaaaaaaaaaaaaaggaaaaaaaaaaaaaaaaaaaaaaaaaaaaacctggtgggccgcttgggccaagtggattttaaattgggccaggtttatcatgggggccgaatttggggctaattgggcaaattgcccttatggggggccgtttaacaattaatggcccgcg

SEQ ID NO: 357253 - DNA, 1701 bp, Homo sapiens
ttagggcccatcacaggtccccaagggactcccccccaccagccgagagggggaattccccgggcccgaaggtggaaggcctcccgccccgccactcaagaccccgtcacgccggcccgaaactcatgcccgctccaacactccccggctcgccctctgggcttcaaggaactgacaggaggcgctgggcatccagccccgctctcctcgacagaggcttggacccttgccgcagcttgggcccccgggctcgggcgagggcagcgccccgccggagtctcccggctgtgtagtcccggagagccccgggccccgaggggccgaacggccgctacgacggcggcgaatctcgggctcctgacctggcggacccggtagctgggggcgggagaccggcggggagacaacccgaccaggtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaacactttgtcctgctgtcaatcatgtttgcagtgagaagcccaaaacaatctggctctggcctgcaccatccacacacccccattcccattttcccctcgagtcaaccacagctcctggaacacaaccagttgattttgtttctgggccttagcacatgttggtctctacctggatgccttcagaagctcatctgcctgaaaaactcccttccatccttccagactcagttcagacatcccctcctctggactcctgcctagcaggtcctcctgtataaatggacaggcttgattccacagggtgcttggggaggcagaactcagtttgttctcactgagagaagcttccaggtacttctctgattaggcagagatggagaagccaggtctccgttctctcaagaagcgctagtgatcaccctcagatggagaataaaggccagcccttcgctctggggaaagggcgtaacagcagcttttcgagggc

SEQ ID NO: 357254 - DNA, 436 bp, Homo sapiens
atccacttccaagctcactcatgtggaggttgacaggagacttcagttctgcaccacccatgtgggcctctctgtagggctggtcatgacataacttcccctagatagagtgatcaagacagagtgaacccaattctgaagccacagtcttgtaacctcgaaagagacaagcagtcacttctgccctactctattggccatgtagaccaatcttggtacagtatgtgaggagagggtgtgaataccaggatgtggggtcattgggggccatcttggaggctggccacctcataaggtatttaaacttattatgtttaagttgcatgttcctacctgctttctgtggactgtgttttcaaagcttttggaaaattattcaaatccgtactgtgtgtgtgcgccacccagtaggcaatctgggacctaagtggtgttc

SEQ ID NO: 357255 - DNA, 457 bp, Homo sapiens
cttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcagccttggaagtcagaagtccaaggtcaaggtggtagcaggactggttccttctggaggtgctgagggaaaaaacccttccctgccaaaggtgactgtgttttctgccgccgaaggagggcccggtccctccaggctcagtgtggcttctccctgacccccgccctagaacttttgccagtgccttttctgaaactcctgtgtcccgggccccccaggcggagaaggatatgccggattctgcctggggctgggctctaggagaccccaaatttgacaccacagaaagcaaataaaacacttgaaatacgaaaaaaaaaaa

SEQ ID NO: 357256 - DNA, 392 bp, Homo sapiens
cttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcaggaaaaaacccttccctgccaaaggtgactgtgttttctgccgccgaaggagggcccggtccctccaggctcagtgtggcttctccctgacccccgccctagaacttttgccagtgccttttctgaaactcctgtgtcccgggccccccaggcggagaaggatatgccggattctgcctggggctgggctctaggagaccccaaatttgacaccacagaaagcaaataaaacacttgaaatacgaaaaaaaaaaa

SEQ ID NO: 357257 - DNA, 501 bp, Homo sapiens
agatgcagcttcaccatgttggccaggctggtcttgaaatcctgacctcaggtgatctgcctgccttggcctcccaaagtgctgggattacaggtgtgagctactgcgcctggccaagttttttacaaatatttttcttttggtggaactcatctgtgcactctctggtgtgtttttccacctttgttgggtcttggcttaaaatatcctcatgtgggctaggtgtggttactcacacctgtaatcctagcactttgggaggttgaggcaggagaatcccttgagccaggagttcaagaccagcctgggcaacatagcaagagatcccatatctaccaaaacatacaagaattagccagatgtggtggtgcatgcctgtggtcccagatactcaggaggctgaggcaggaggatcacctatgcctgggaggttgaagccccagtgagccatgatcacaccactgtagtccagcccgggtgacacagcaagactctgtctca

SEQ ID NO: 357258 - DNA, 2624 bp, Homo sapiens
aaaagacaggctgaggggtgtggtgggaaggctgggggagaaaggtgagaagtgattgggggggcttccctgatgagtcctcatggagggtgctgaggcagggaacaggggtgcagggacagtgatcagggcacctggtaccctgaccaacttgatgatggcatctcttttaagatgcccaagtctgcgcacttttattcctttattcggcccctagcaccccctccccaccccaaagaaggtcagttgcatgcgtgtggggatgtagctcaaaaaagaaataagatggagtggaaaggaaagaaaggaagaagcaggaattcaaggtgggtgggctgagcttggggccacctagcccacctgctccaatcaagggctggaacaaacctgaggccacttggagaggcagggctgggcagggacagggggtgggggccgaaatcacagcttccccatcagagccagatgtgtgaaggaaatgtcccagatggcagtagtttctcggcaaggaggggaatcctggagatggttcatgtctgtgatcccagtgctttgggaggctgaggtgggaggattgcttgagcccgggagttcgagaccagccctgggcaacatggcgagaccccatctctacagaaattaaaaaaaaaattagccagttgtggtgtcaagcacctgtagtcccagctacttgggaggctgagttgggaggcttatctgagcccaggaggtgaaggctgcaatgagccatgattacactactgtaccccagcctgggcaacagagcaagaccctgcctcaaaattaagaaaaaaaaaaggggggccaggcgcagtggcttatgcctgttatcccagcactttgggaggccaaggcagactgatcgcttgaggccaggagtttgcgaccagcctggccaacatagcaaaaccccatctctactaaaaatacaaaaattagtcaagagtggatggtgcgtgcctgtaatcccagctacctgggaggctgagacaggagaattgcttgaacctgggaggcagaggttgcagtggtgtgagatcacgccactgcattccagactgggcaacatagcaagactctgtcacaaaaaaaaaaaaaaagaattccctgctctgcttttctgctcgttgctggcatagaaacatctagaacagaaagtatccactctggggcagatgggagagctggaaaagtagattcaagatgccttttagtcttggaagtttcttccaggaagcaagaccagctggtatgtttacacctgcactccagtgccctggggaggtgaccaggtggagggggatggctcatggaaatctgtcccgcacagctggcccccttttggctgccactgtctagactgttggcctttgacctctctgcctcttgtggcgtctgaacctagacgtcccttttggagacagctggacaaagccctattctccgcagccccagcctctatcctgaggcctctgggagctgcgtgacggccagcatggggtgctgatcatggtcaaggaggcaggtctttgccaggttgccccatgcagccacccatcctcagcatcctaacttgagggggcaggagagggctttgtttttataatccggattaaatttcccttccctgggcacaagtgcctcatgagggcccggggctgctggttgggagggaaagcatccccgtttttgcagtgaggaggccggccgagggctggggttccacttagacccttggcagaatggctgttgaggggcaggcgctgcccagtgcccacgtctggaaagctaattcccgggtggacgctgaacatacctgctgagagactctgtcccctggtttccaggacagttgtcacaagctgagtggggggggactcccaggacttgagggacccagtcccaccccaaactgctccccctcccccaaattccctttctcctcctgctctttctccccgctgtgcctcccccagttacccacagaagtgcctgcctctccagcgctcacagaacacacaaaaagggacaggaattggtcactgggtagtggccgtggctcctgacgatccagaccagcgtctggcccaagccattcagaggtggggtctggggcctgggggttttgtgtcgtgacactttgtctcaaggagattccacatagggatttgaattaggctttctgcttgccaaggcctgtggcatctgagcctggctgagggccgggcaagcctcccctgagcctttggaagccgagttcactctctgcctgcccaggggagcaccggcttggttctgggggctcctctaacatctcaggtttttatcttgtcttaaatttctttctaggaaaaaacccttccctgccaaaggtgactgtgttttctgccgccgaaggagggcccggtccctccaggctcagtgtggcttctccctgacccccgccctagaacttttgccagtgccttttctgaaactcctgtgtcccgggccccccaggcggagaaggatatgccggattctgcctggggctgggctctaggagaccccaaatttgacaccacagaaagcaaataaaacacttgaaatacgaaaaaaaaaaa

SEQ ID NO: 357259 - DNA, 2495 bp, Homo sapiens
aaaagacaggctgaggggtgtggtgggaaggctgggggagaaaggtgagaagtgattgggggggcttccctgatgagtcctcatggagggtgctgaggcagggaacaggggtgcagggacagtgatcagggcacctggtaccctgaccaacttgatgatggcatctcttttaagatgcccaagtctgcgcacttttattcctttattcggcccctagcaccccctccccaccccaaagaaggtcagttgcatgcgtgtggggatgtagctcaaaaaagaaataagatggagtggaaaggaaagaaaggaagaagcaggaattcaaggtgggtgggctgagcttggggccacctagcccacctgctccaatcaagggctggaacaaacctgaggccacttggagaggcagggctgggcagggacagggggtgggggccgaaatcacagcttccccatcagagccagatgtgtgaaggaaatgtcccagatggcagtagtttctcggcaaggaggggaatcctggagatggttcatgtctgtgatcccagtgctttgggaggctgaggtgggaggattgcttgagcccgggagttcgagaccagccctgggcaacatggcgagaccccatctctacagaaattaaaaaaaaaattagccagttgtggtgtcaagcacctgtagtcccagctacttgggaggctgagttgggaggcttatctgagcccaggaggtgaaggctgcaatgagccatgattacactactgtaccccagcctgggcaacagagcaagaccctgcctcaaaattaagaaaaaaaaaaggggggccaggcgcagtggcttatgcctgttatcccagcactttgggaggccaaggcagactgatcgcttgaggccaggagtttgcgaccagcctggccaacatagcaaaaccccatctctactaaaaatacaaaaattagtcaagagtggatggtgcgtgcctgtaatcccagctacctgggaggctgagacaggagaattgcttgaacctgggaggcagaggttgcagtggtgtgagatcacgccactgcattccagactgggcaacatagcaagactctgtcacaaaaaaaaaaaaaaagaattccctgctctgcttttctgctcgttgctggcatagaaacatctagaacagaaagtatccactctggggcagatgggagagctggaaaagtagattcaagatgccttttagtcttggaagtttcttccaggaagcaagaccagctggtatgtttacacctgcactccagtgccctggggaggtgaccaggtggagggggatggctcatggaaatctgtcccgcacagctggcccccttttggctgccactgtctagactgttggcctttgacctctctgcctcttgtggcgtctgaacctagacgtcccttttggagacagctggacaaagccctattctccgcagccccagcctctatcctgaggcctctgggagctgcgtgacggccagcatggggtgctgatcatggtcaaggaggcaggtctttgccaggttgccccatgcagccacccatcctcagcatcctaacttgagggggcaggagagggctttgtttttataatccggattaaatttcccttccctgggcacaagtgcctcatgagggcccggggctgctggttgggagggaaagcatccccgtttttgcagtgaggaggccggccgagggctggggttccacttagacccttggcagaatggctgttgaggggcaggcgctgcccagtgcccacgtctggaaagctaattcccgggtggacgctgaacatacctgctgagagactctgtcccctggtttccaggacagttgtcacaagctgagtggggggggactcccaggacttgagggacccagtcccaccccaaactgctccccctcccccaaattccctttctcctcctgctctttctccccgctgtgcctcccccagttacccacagaagtgcctgcctctccagcgctcacagaacacacaaaaagggacaggaattggtcactgggtagtggccgtggctcctgacgatccagaccagcgtctggcccaagccattcagaggtggggtctggggcctgggggttttgtgtcgtgacactttgtctcaaggagattccacatagggatttgaattaggctttctgcttgccaaggcctgtggcatctgagcctggctgagggccgggcaagcctcccctgagcctttggaagccgagttcactctctgcctgcccaggggagcaccggcttggttctgggggctcctctaacatctcaggtttttatcttgtcttaaatttctttctaggccaggcgtgatggctcatgcctgtaatcccagcactttgggaggccgagttgggaggatcgcttgagcccaggagttcaagaccagcctgggcaacatagtgagactctgtctctacaaaaaaa

SEQ ID NO: 357260 - DNA, 493 bp, Homo sapiens
gagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttcagcttggggatccgatctggaagagagattctgatctgcccacctcctcttcctccttctctacaaaagctccggttgattcgaggaaaaaacccttccctgccaaaggtgactgtgttttctgccgccgaaggagggcccggtccctccaggctcagtgtggcttctccctgacccccgccctagaacttttgccagtgccttttctgaaactcctgtgtcccgggccccccaggcggagaaggatatgccggattctgcctggggctgggctctaggagaccccaaatttgacaccacagaaagcaaataaaacacttgaaatacgaaaaaaaaaaa

SEQ ID NO: 357261 - DNA, 338 bp, Homo sapiens
gcggcatggcaagggaggacgagtttaatttaggggactcacgacacttcacgggtttttatcttgtcttaaatttctttctaggaaaaaacccttccctgccaaaggtgactgtgttttctgccgccgaaggagggcccggtccctccaggctcagtgtggcttctccctgacccccgccctagaacttttgccagtgccttttctgaaactcctgtgtcccgggccccccaggcggagaaggatatgccggattctgcctggggctgggctctaggagaccccaaatttgacaccacagaaagcaaataaaacacttgaaatacgaaaaaaaaaaa

SEQ ID NO: 357262 - DNA, 300 bp, Homo sapiens
gagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttcagcttggggatccgatctggaagagagattctgatctgcccacctcctcttcctccttctctacaaaagctccggttgattcgagggaagtggtgaaaatttttttttctcccattttcctccctgcatctggggacacagctgcc

SEQ ID NO: 357263 - DNA, 2017 bp, Homo sapiens
agatgcagcttcaccatgttggccaggctggtcttgaaatcctgacctcaggtgatctgcctgccttggcctcccaaagtgctgggattacaggtgtgagctactgcgcctggccaagttttttacaaatatttttcttttggtggaactcatctgtgcactctctggtgtgtttttccacctttgttgggtcttggcttaaaatatcctcatgtgggctaggtgtggttactcacacctgtaatcctagcactttgggaggccaaggcagactgatcgcttgaggccaggagtttgcgaccagcctggccaacatagcaaaaccccatctctactaaaaatacaaaaattagtcaagagtggatggtgcgtgcctgtaatcccagctacctgggaggctgagacaggagaattgcttgaacctgggaggcagaggttgcagtggtgtgagatcacgccactgcattccagactgggcaacatagcaagactctgtcacaaaaaaaaaaaaaaagaattccctgctctgcttttctgctcgttgctggcatagaaacatctagaacagaaagtatccactctggggcagatgggagagctggaaaagtagattcaagatgccttttagtcttggaagtttcttccaggaagcaagaccagctggtatgtttacacctgcactccagtgccctggggaggtgaccaggtggagggggatggctcatggaaatctgtcccgcacagctggcccccttttggctgccactgtctagactgttggcctttgacctctctgcctcttgtggcgtctgaacctagacgtcccttttggagacagctggacaaagccctattctccgcagccccagcctctatcctgaggcctctgggagctgcgtgacggccagcatggggtgctgatcatggtcaaggaggcaggtctttgccaggttgccccatgcagccacccatcctcagcatcctaacttgagggggcaggagagggctttgtttttataatccggattaaatttcccttccctgggcacaagtgcctcatgagggcccggggctgctggttgggagggaaagcatccccgtttttgcagtgaggaggccggccgagggctggggttccacttagacccttggcagaatggctgttgaggggcaggcgctgcccagtgcccacgtctggaaagctaattcccgggtggacgctgaacatacctgctgagagactctgtcccctggtttccaggacagttgtcacaagctgagtggggggggactcccaggacttgagggacccagtcccaccccaaactgctccccctcccccaaattccctttctcctcctgctctttctccccgctgtgcctcccccagttacccacagaagtgcctgcctctccagcgctcacagaacacacaaaaagggacaggaattggtcactgggtagtggccgtggctcctgacgatccagaccagcgtctggcccaagccattcagaggtggggtctggggcctgggggttttgtgtcgtgacactttgtctcaaggagattccacatagggatttgaattaggctttctgcttgccaaggcctgtggcatctgagcctggctgagggccgggcaagcctcccctgagcctttggaagccgagttcactctctgcctgcccaggggagcaccggcttggttctgggggctcctctaacatctcaggtttttatcttgtcttaaatttctttctaggaaaaaacccttccctgccaaaggtgactgtgttttctgccgccgaaggagggcccggtccctccaggctcagtgtggcttctccctgacccccgccctagaacttttgccagtgccttttctgaaactcctgtgtcccgggccccccaggcggagaaggatatgccggattctgcctggggctgggctctaggagaccccaaatttgacaccacagaaagcaaataaaacacttgaaatacgaaaaaaaaaaa

SEQ ID NO: 357264 - DNA, 630 bp, Homo sapiens
tctcggcgatttttacgatctaacttcgagataaaacccctatccatttgacatctaaatgtcatagcgacttttgggatagtttgctatcgacaaagggagacaaagtcaaggggtgaagggaaaggagggccaagtagagcctccacgaccctcggcttcctcctcaccagctccccctccctccaagtccagtaagaagttgggccaagctggaagggattgaccggccgtttcctctccctcgccggcctcggcggagattccaggccctatagaaaccaggacgtcccttagcgccaccgcctcacatgccagtgctgccgggaacccagcgatatccgcaccagcggagaaggttccaggctgccggcggcggcgcagagagcgggaagagaggctcggaggaagccccgggcgtggcgtggtcaggctccgagagcggccgggatgcggccacaccggcctggtaaactcgcacctcttaggatcttgctcccggactcattcccttccccaccccctattttaaagttttatttgggtcgtctgtatcaatttagaacgagataaattaagacaaagaaagtaaaataaatcgaaataaaatataggaatagctcttggcga

SEQ ID NO: 357265 - DNA, 558 bp, Homo sapiens
  misc_feature (1)..(1): n is a, c, g, or t
  misc_feature (11)..(11): n is a, c, g, or t
ntagctgcagnggctctcttaattaccccgctcaggctttggggagggggtgggagagacgacaggtctgggatcagggagtcttcaaggcccccgctgaggggacagcgaatctaccattgaaccgtgcacgggggacatggacaaaatgagacgcgacagggacaagagcattttgctctgcttccaggaaacatcaagttgcttgtctggagatggagccactacaggcgggcctgggcgcctggagtcgggcatgaaagaaaatagcgcctcatcgctcttatctaagcccagaggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccggtttgtcttttgacaaccgagtggaactgacggggccggcgcctgccctgcgggtcccctcccttggctgagaagaaaaccaaataaaccttgaacagcct

SEQ ID NO: 357266 - DNA, 1002 bp, Homo sapiens
tctcggcgatttttacgatctaacttcgagataaaacccctatccatttgacatctaaatgtcatagcgacttttgggatagtttgctatcgacaaagggagacaaagtcaaggggtgaagggaaaggagggccaagtagagcctccacgaccctcggcttcctcctcaccagctccccctccctccaagtccagtaagaagttgggccaagctggaagggattgaccgggttgcttgtctggagatggagccactacaggcgggcctgggcgcctggagtcgggcatgaaagaaaatagcgcctcatcgctcttatctaagcccagaggtccaggggacaacctgagggccctgaagtgtttcaataccatgtaccagcttgacttctctacatgtcctttggattgcccaaaagcaaaatctcagaggggccaaggaccttctaggggggtcgtctgctctgtctggacacacaagaaccatcatgcgtgtgagagcctttggcatgagagacacaaagccacagggaaacacatggtgtggagactgtgctgagagcagagatgcagagatgcagagacagcagagatgcagagacagcagagatgcagagacagcagagagtggacgaacgaggagggtgtggggtggctggggatggcgtgaggtccagggaacaggaggggctctcgtgcaccagcgtgggtggagaaatcaaacaggatgaagcctcgacagaaagaacaggacacgagactgaggaagctccgagagagcagcgagggagaccagtggctggaaaatgagaaaacaaagccactgaggccccagcagcagccccagcgccgaccagcagggggcacaggacagagaagaggaagcggcagcagccccagcgccgaccagcagcgggcacaggacagagaagaggaagccgcagcagctccagtgcctaaccagcagcgggcacaggacagagaagaggaagccgcagcagcccc

SEQ ID NO: 357267 - DNA, 1798 bp, Homo sapiens
gagactagccctctcctcacttggtgatatggagtgaaggagtgaggggtatccctcagcctaggtggctttatttgtctgatccctatcctgcctgcaaccctcactccagtaccctctacaatcccaaaagacttaagaatagcctgggctataggattttcaggaatcagggatgtcccagtaaatctgggcacaaggaagaaatcattcttcttccagttgtgggctttgaaccctcctgatagttgaggcagtcagagaccactgggaagaaatgcatcctcactcctcttctaagtctctgtaggagctgccagttctttttaaaattaattctttcccaagacttggtttttgctttagtttgatagggagagaaggtcgtttgcgttctcttggggactcagcaggctgttccagccatcagccagcatcccctctcccttctgtctgtatctcagcatcgctacaattccctcccacaccccgtgtttgtatcatcagctttgccgccttacaaatttaggtgtgtcagagaatgtatgtctctggctctttcatccaaggaaaataagcattgagcccaggctgggagacagggccacagtgcattcccaacattctaatatacatacacaggccaagtagtgaagggtgacaaccttcacacctggggacaagaaggggccagggcatggaacaaagtcagatgtcaggccaggctgaccctcctctgccttgtccttcctttgggctcctttttctggccaagttctgcccactgaagatggtacaagacactagggaaggtggcaggggactgagcttggatcaccaagggtgggaacttatttggttgcacgtggtctccaaggctctctaaactcagggcaacttcttggctgtaccttaatggcaaaatagccatccctagatggcctccaattacttcctaacctgactctgtgggagtgtttgataagcatttaagaaaacaaatttaaaccccctgataatgaagaaggataaatattccatatctaggtatggctgggcttgcttctagagaggactaggggccatttgaacagggggagaaaagtgggagagagtacctgcatgcacctccctgcctactgctgaggctgagccctgggcctcagccttccctgcctcctccctgcccacaatgtctccatcctagcactaaatagtgtggttttctcagtgaagtctgaacaaaataagatctggtgaggaagggagcatttccctgtgtcagaagcagggaaataattgccttatctttagagtcacagcccccaaattaacctcacctctgcaggttgcttgtctggagatggagccactacaggcgggcctgggcgcctggagtcgggcatgaaagaaaatagcgcctcatcgctcttatctaagcccagaggtatttatgagcgtttattcgtctgatccgtttgtttgggaaaaagagcaggcgggcagggcaggccagagaccgactcctttctggagccagatccctacgaatctgtctgtggttcggtccaccgccctctgtctgtctccttgggggaatatgtaaatacacagcgggctcagccatccgccagtctggggtgtctctccctgcctcaatgaggaagtgtgtgttcagagagatggatagaagtgtgtaccaattcttgagtacataacagagggattgtacagataccccacaggcaggatttataattgtaattttctatgctgtgagtctgcagtcctgtgggca

SEQ ID NO: 357268 - DNA, 428 bp, Homo sapiens
ggaagccgcttcccttgccagccgccagccgtttcctctccctcgccggcctcggcggagattccaggccctatagaaaccaggacgtcccttagcgccaccgcctcacatgccagtgctgccgggaacccagcgatatccgcaccagcggagaaggttccaggctgccggcggcggcgcagagagcgggaagagaggctcggaggaagccccgggcgtggcgtggtcaggctccgagagcggccgggatgcggccacaccggcctggtaaactcgcacctcttaggatcttgctcccggactcattcccttccccaccccctattttaaagttttatttgggtcgtctgtatcaatttagaacgagataaattaagacaaagaaagtaaaataaatcgaaataaaatataggaatagctcttggcga

SEQ ID NO: 357269 - DNA, 422 bp, Homo sapiens
tcttgatctggcgctcggacaggcagagtgcgtgggcgatctcgatgcgccgtcgccgggtcaggttgcttgtctggagatggagccactacaggcgggcctgggcgcctggagtcgggcatgaaagaaaatagcgcctcatcgctcttatctaagcccagaggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccggtttgtcttttgacaaccgagtggaactgacggggccggcgcctgccctgcgggtcccctcccttggctgagaagaaaaccaaataaaccttgaacagcct

SEQ ID NO: 357270 - DNA, 588 bp, Homo sapiens
tctcggcgatttttacgatctaacttcgagataaaacccctatccatttgacatctaaatgtcatagcgacttttgggatagtttgctatcgacaaagggagacaaagtcaaggggtgaagggaaaggagggccaagtagagcctccacgaccctcggcttcctcctcaccagctccccctccctccaagtccagtaagaagttgggccaagctggaagggattgaccgggttgcttgtctggagatggagccactacaggcgggcctgggcgcctggagtcgggcatgaaagaaaatagcgcctcatcgctcttatctaagcccagaggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccggtttgtcttttgacaaccgagtggaactgacggggccggcgcctgccctgcgggtcccctcccttggctgagaagaaaaccaaataaaccttgaacagcct

SEQ ID NO: 357271 - DNA, 484 bp, Homo sapiens
gcgtcggttctggaaccatatcttgatctgcctctccgtcaggcacagggcgtgcgcgatctcgatgcgccgccgccgggtcagccgtttcctctccctcgccggcctcggcggagattccaggccctatagaaaccaggacgtcccttagcgccaccgcctcacatgccagtgctgccgggaacccagcgatatccgcaccagcggagaaggttccaggctgccggcggcggcgcagagagcgggaagagaggctcggaggaagccccgggcgtggcgtggtcaggctccgagagcggccgggatgcggccacaccggcctggtaaactcgcacctcttaggatcttgctcccggactcattcccttccccaccccctattttaaagttttatttgggtcgtctgtatcaatttagaacgagataaattaagacaaagaaagtaaaataaatcgaaataaaatataggaatagctcttggcga

SEQ ID NO: 357272 - DNA, 434 bp, Homo sapiens
gttttcttattttttaaaggataattgaggaaaaaaaaaatcaagatttggggggaattacctacaaagatgtaaggttgcttgtctggagatggagccactacaggcgggcctgggcgcctggagtcgggcatgaaagaaaatagcgcctcatcgctcttatctaagcccagaggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccggtttgtcttttgacaaccgagtggaactgacggggccggcgcctgccctgcgggtcccctcccttggctgagaagaaaaccaaataaaccttgaacagcct

SEQ ID NO: 357273 - DNA, 489 bp, Homo sapiens
tctcggcgatttttacgatctaacttcgagataaaacccctatccatttgacatctaaatgtcatagcgacttttgggatagtttgctatcgacaaagggagacaaagtcaaggggtgaagggaaaggagggccaagtagagcctccacgaccctcggcttcctcctcaccagctccccctccctccaagtccagtaagaagttgggccaagctggaagggattgaccgggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccggtttgtcttttgacaaccgagtggaactgacggggccggcgcctgccctgcgggtcccctcccttggctgagaagaaaaccaaataaaccttgaacagcct

SEQ ID NO: 357274 - DNA, 323 bp, Homo sapiens
tcttgatctggcgctcggacaggcagagtgcgtgggcgatctcgatgcgccgtcgccgggtcaggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccggtttgtcttttgacaaccgagtggaactgacggggccggcgcctgccctgcgggtcccctcccttggctgagaagaaaaccaaataaaccttgaacagcct

SEQ ID NO: 357275 - DNA, 1942 bp, Homo sapiens
gagactagccctctcctcacttggtgatatggagtgaaggagtgaggggtatccctcagcctaggtggctttatttgtctgatccctatcctgcctgcaaccctcactccagtaccctctacaatcccaaaagacttaagaatagcctgggctataggattttcaggaatcagggatgtcccagtaaatctgggcacaaggaagaaatcattcttcttccagttgtgggctttgaaccctcctgatagttgaggcagtcagagaccactgggaagaaatgcatcctcactcctcttctaagtctctgtaggagctgccagttctttttaaaattaattctttcccaagacttggtttttgctttagtttgatagggagagaaggtcgtttgcgttctcttggggactcagcaggctgttccagccatcagccagcatcccctctcccttctgtctgtatctcagcatcgctacaattccctcccacaccccgtgtttgtatcatcagctttgccgccttacaaatttaggtgtgtcagagaatgtatgtctctggctctttcatccaaggaaaataagcattgagcccaggctgggagacagggccacagtgcattcccaacattctaatatacatacacaggccaagtagtgaagggtgacaaccttcacacctggggacaagaaggggccagggcatggaacaaagtcagatgtcaggccaggctgaccctcctctgccttgtccttcctttgggctcctttttctggccaagttctgcccactgaagatggtacaagacactagggaaggtggcaggggactgagcttggatcaccaagggtgggaacttatttggttgcacgtggtctccaaggctctctaaactcagggcaacttcttggctgtaccttaatggcaaaatagccatccctagatggcctccaattacttcctaacctgactctgtgggagtgtttgataagcatttaagaaaacaaatttaaaccccctgataatgaagaaggataaatattccatatctaggtatggctgggcttgcttctagagaggactaggggccatttgaacagggggagaaaagtgggagagagtacctgcatgcacctccctgcctactgctgaggctgagccctgggcctcagccttccctgcctcctccctgcccacaatgtctccatcctagcactaaatagtgtggttttctcagtgaagtctgaacaaaataagatctggtgaggaagggagcatttccctgtgtcagaagcagggaaataattgccttatctttagagtcacagcccccaaattaacctcacctctgcaggttgcttgtctggagatggagccactacaggcgggcctgggcgcctggagtcgggcatgaaagaaaatagcgcctcatcgctcttatctaagcccagaggtccaggggacaacctgagggccctgaagtgtttcaataccatgtaccagcttgacttctctacatgtcctttggattgcccaaaagcaaaatctcagaggggccaaggaccttctagggctggctccctcagggcctcctatagagcagctccttgagtcgggccttatagccaccagaaagtcacctcgccgcaggaaagctataaagagctgctccagaggcgccgaaagagggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccggtttgtcttttgacaaccgagtggaactgacggggccggcgcctgccctgcgggtcccctcccttggctgagaagaaaaccaaataaaccttgaacagcct

SEQ ID NO: 357276 - DNA, 2652 bp, Homo sapiens
gagactagccctctcctcacttggtgatatggagtgaaggagtgaggggtatccctcagcctaggtggctttatttgtctgatccctatcctgcctgcaaccctcactccagtaccctctacaatcccaaaagacttaagaatagcctgggctataggattttcaggaatcagggatgtcccagtaaatctgggcacaaggaagaaatcattcttcttccagttgtgggctttgaaccctcctgatagttgaggcagtcagagaccactgggaagaaatgcatcctcactcctcttctaagtctctgtaggagctgccagttctttttaaaattaattctttcccaagacttggtttttgctttagtttgatagggagagaaggtcgtttgcgttctcttggggactcagcaggctgttccagccatcagccagcatcccctctcccttctgtctgtatctcagcatcgctacaattccctcccacaccccgtgtttgtatcatcagctttgccgccttacaaatttaggtgtgtcagagaatgtatgtctctggctctttcatccaaggaaaataagcattgagcccaggctgggagacagggccacagtgcattcccaacattctaatatacatacacaggccaagtagtgaagggtgacaaccttcacacctggggacaagaaggggccagggcatggaacaaagtcagatgtcaggccaggctgaccctcctctgccttgtccttcctttgggctcctttttctggccaagttctgcccactgaagatggtacaagacactagggaaggtggcaggggactgagcttggatcaccaagggtgggaacttatttggttgcacgtggtctccaaggctctctaaactcagggcaacttcttggctgtaccttaatggcaaaatagccatccctagatggcctccaattacttcctaacctgactctgtgggagtgtttgataagcatttaagaaaacaaatttaaaccccctgataatgaagaaggataaatattccatatctaggtatggctgggcttgcttctagagaggactaggggccatttgaacagggggagaaaagtgggagagagtacctgcatgcacctccctgcctactgctgaggctgagccctgggcctcagccttccctgcctcctccctgcccacaatgtctccatcctagcactaaatagtgtggttttctcagtgaagtctgaacaaaataagatctggtgaggaagggagcatttccctgtgtcagaagcagggaaataattgccttatctttagagtcacagcccccaaattaacctcacctctgcaggttgcttgtctggagatggagccactacaggcgggcctgggcgcctggagtcgggcatgaaagaaaatagcgcctcatcgctcttatctaagcccagaggtccaggggacaacctgagggccctgaagtgtttcaataccatgtaccagcttgacttctctacatgtcctttggattgcccaaaagcaaaatctcagaggggccaaggaccttctagggctggctccctcagggcctcctatagagcagctccttgagtcgggccttatagccaccagaaagtcacctcgccgcaggaaagctataaagagctgctccagaggcgccgaaagagggtgagggctgcagccacagtgtttgtccccagcaccaccaggccccttaacctcgtcagctcctctagccctcggccagactctggcaacaccttggtttgcctggcaccgcaggcaatttcctggaaccccacccccacccaggaacggggaccacagcacctttaaaggaactgccagagcttcctcctacggcttgaaagcccaagctaatcagtaacccgtgagacaggggccaatattcaaacgctgcagcagaggcgcatagcctagccctggccaccccctcttgggaaggaggtcgagttaagccggtgtggagggtccaacaggaacggaaattacgacggtgtggttccttaaggatttggccccagtcccactaccaaatttttcccaaatcatatttaggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccgccgtttcctctccctcgccggcctcggcggagattccaggccctatagaaaccaggacgtcccttagcgccaccgcctcacatgccagtgctgccgggaacccagcgatatccgcaccagcggagaaggttccaggctgccggcggcggcgcagagagcgggaagagaggctcggaggaagccccgggcgtggcgtggtcaggctccgagagcggccgggatgcggccacaccggcctggtaaactcgcacctcttaggatcttgctcccggactcattcccttccccaccccctattttaaagttttatttgggtcgtctgtatcaatttagaacgagataaattaagacaaagaaagtaaaataaatcgaaataaaatataggaatagctcttggcga

SEQ ID NO: 357277 - DNA, 2353 bp, Homo sapiens
gagactagccctctcctcacttggtgatatggagtgaaggagtgaggggtatccctcagcctaggtggctttatttgtctgatccctatcctgcctgcaaccctcactccagtaccctctacaatcccaaaagacttaagaatagcctgggctataggattttcaggaatcagggatgtcccagtaaatctgggcacaaggaagaaatcattcttcttccagttgtgggctttgaaccctcctgatagttgaggcagtcagagaccactgggaagaaatgcatcctcactcctcttctaagtctctgtaggagctgccagttctttttaaaattaattctttcccaagacttggtttttgctttagtttgatagggagagaaggtcgtttgcgttctcttggggactcagcaggctgttccagccatcagccagcatcccctctcccttctgtctgtatctcagcatcgctacaattccctcccacaccccgtgtttgtatcatcagctttgccgccttacaaatttaggtgtgtcagagaatgtatgtctctggctctttcatccaaggaaaataagcattgagcccaggctgggagacagggccacagtgcattcccaacattctaatatacatacacaggccaagtagtgaagggtgacaaccttcacacctggggacaagaaggggccagggcatggaacaaagtcagatgtcaggccaggctgaccctcctctgccttgtccttcctttgggctcctttttctggccaagttctgcccactgaagatggtacaagacactagggaaggtggcaggggactgagcttggatcaccaagggtgggaacttatttggttgcacgtggtctccaaggctctctaaactcagggcaacttcttggctgtaccttaatggcaaaatagccatccctagatggcctccaattacttcctaacctgactctgtgggagtgtttgataagcatttaagaaaacaaatttaaaccccctgataatgaagaaggataaatattccatatctaggtatggctgggcttgcttctagagaggactaggggccatttgaacagggggagaaaagtgggagagagtacctgcatgcacctccctgcctactgctgaggctgagccctgggcctcagccttccctgcctcctccctgcccacaatgtctccatcctagcactaaatagtgtggttttctcagtgaagtctgaacaaaataagatctggtgaggaagggagcatttccctgtgtcagaagcagggaaataattgccttatctttagagtcacagcccccaaattaacctcacctctgcaggttgcttgtctggagatggagccactacaggcgggcctgggcgcctggagtcgggcatgaaagaaaatagcgcctcatcgctcttatctaagcccagaggtccaggggacaacctgagggccctgaagtgtttcaataccatgtaccagcttgacttctctacatgtcctttggattgcccaaaagcaaaatctcagaggggccaaggaccttctagggctggctccctcagggcctcctatagagcagctccttgagtcgggccttatagccaccagaaagtcacctcgccgcaggaaagctataaagagctgctccagaggcgccgaaagagggtgagggctgcagccacagtgtttgtccccagcaccaccaggccccttaacctcgtcagctcctctagccctcggccagactctggcaacaccttggtttgcctggcaccgcaggcaatttcctggaaccccacccccacccaggaacggggaccacagcacctttaaaggaactgccagagcttcctcctacggcttgaaagcccaagctaatcagtaacccgtgagacaggggccaatattcaaacgctgcagcagaggcgcatagcctagccctggccaccccctcttgggaaggaggtcgagttaagccggtgtggagggtccaacaggaacggaaattacgacggtgtggttccttaaggatttggccccagtcccactaccaaatttttcccaaatcatatttaggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccggtttgtcttttgacaaccgagtggaactgacggggccggcgcctgccctgcgggtcccctcccttggctgagaagaaaaccaaataaaccttgaacagcct

SEQ ID NO: 357278 - DNA, 1706 bp, Homo sapiens
gagactagccctctcctcacttggtgatatggagtgaaggagtgaggggtatccctcagcctaggtggctttatttgtctgatccctatcctgcctgcaaccctcactccagtaccctctacaatcccaaaagacttaagaatagcctgggctataggattttcaggaatcagggatgtcccagtaaatctgggcacaaggaagaaatcattcttcttccagttgtgggctttgaaccctcctgatagttgaggcagtcagagaccactgggaagaaatgcatcctcactcctcttctaagtctctgtaggagctgccagttctttttaaaattaattctttcccaagacttggtttttgctttagtttgatagggagagaaggtcgtttgcgttctcttggggactcagcaggctgttccagccatcagccagcatcccctctcccttctgtctgtatctcagcatcgctacaattccctcccacaccccgtgtttgtatcatcagctttgccgccttacaaatttaggtgtgtcagagaatgtatgtctctggctctttcatccaaggaaaataagcattgagcccaggctgggagacagggccacagtgcattcccaacattctaatatacatacacaggccaagtagtgaagggtgacaaccttcacacctggggacaagaaggggccagggcatggaacaaagtcagatgtcaggccaggctgaccctcctctgccttgtccttcctttgggctcctttttctggccaagttctgcccactgaagatggtacaagacactagggaaggtggcaggggactgagcttggatcaccaagggtgggaacttatttggttgcacgtggtctccaaggctctctaaactcagggcaacttcttggctgtaccttaatggcaaaatagccatccctagatggcctccaattacttcctaacctgactctgtgggagtgtttgataagcatttaagaaaacaaatttaaaccccctgataatgaagaaggataaatattccatatctaggtatggctgggcttgcttctagagaggactaggggccatttgaacagggggagaaaagtgggagagagtacctgcatgcacctccctgcctactgctgaggctgagccctgggcctcagccttccctgcctcctccctgcccacaatgtctccatcctagcactaaatagtgtggttttctcagtgaagtctgaacaaaataagatctggtgaggaagggagcatttccctgtgtcagaagcagggaaataattgccttatctttagagtcacagcccccaaattaacctcacctctgcaggttgcttgtctggagatggagccactacaggcgggcctgggcgcctggagtcgggcatgaaagaaaatagcgcctcatcgctcttatctaagcccagaggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccggtttgtcttttgacaaccgagtggaactgacggggccggcgcctgccctgcgggtcccctcccttggctgagaagaaaaccaaataaaccttgaacagcct

SEQ ID NO: 357279 - DNA, 1145 bp, Homo sapiens
cgagttttcacatctttattattgttgttgttgttgttattattattattattatcatcatcatcatcatcatcatcatcgaagtatttcacgtccagagctaagacaagactacaaacacaacacattccagctcccaggaaaatgtttcctaagttgtgttcagttcgggagtaaaattcttgataggtaacctcaggagggatatttgcgtgtgtgtgtgtgtgtgtgtgtgtgtgtgtggtgtggtgtggtgtgtgtgggagggtgctgagacattgtccaggcttccaatttcctctaagctataaagccctctccctcagctctttgaggtgatgagcaccttctcccaccacccccaactttggctggggtggggtgggatgaaaatatttcaactcaattctcgtcctggactctgtttctctgggtttggggaacataaataaatgttcccaggggtactgagtgatcactcccataggttgagggaggctgtttagatgagacactttgccctaaaatcggcccctccaaatcaaagtacaaagacttcattttcattatgcaaaggagcggcatcctctttgatctttaggggagtgagcagtagtgctgaacccactctcccggtttcctacccgcaggtccaggggacaacctgagggccctgaagtgtttcaataccatgtaccagcttgacttctctacatgtcctttggattgcccaaaagcaaaatctcagaggggccaaggaccttctagggctggctccctcagggcctcctatagagcagctccttgagtcgggccttatagccaccagaaagtcacctcgccgcaggaaagctataaagagctgctccagaggcgccgaaagagggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccggtttgtcttttgacaaccgagtggaactgacggggccggcgcctgccctgcgggtcccctcccttggctgagaagaaaaccaaataaaccttgaacagcct

SEQ ID NO: 357280 - DNA, 887 bp, Homo sapiens
tctcggcgatttttacgatctaacttcgagataaaacccctatccatttgacatctaaatgtcatagcgacttttgggatagtttgctatcgacaaagggagacaaagtcaaggggtgaagggaaaggagggccaagtagagcctccacgaccctcggcttcctcctcaccagctccccctccctccaagtccagtaagaagttgggccaagctggaagggattgaccgggttgcttgtctggagatggagccactacaggcgggcctgggcgcctggagtcgggcatgaaagaaaatagcgcctcatcgctcttatctaagcccagaggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccgccgtttcctctccctcgccggcctcggcggagattccaggccctatagaaaccaggacgtcccttagcgccaccgcctcacatgccagtgctgccgggaacccagcgatatccgcaccagcggagaaggttccaggctgccggcggcggcgcagagagcgggaagagaggctcggaggaagccccgggcgtggcgtggtcaggctccgagagcggccgggatgcggccacaccggcctggtaaactcgcacctcttaggatcttgctcccggactcattcccttccccaccccctattttaaagttttatttgggtcgtctgtatcaatttagaacgagataaattaagacaaagaaagtaaaataaatcgaaataaaatataggaatagctcttggcga

SEQ ID NO: 357281 - DNA, 459 bp, Homo sapiens
  misc_feature (1)..(1): n is a, c, g, or t
  misc_feature (11)..(11): n is a, c, g, or t
ntagctgcagnggctctcttaattaccccgctcaggctttggggagggggtgggagagacgacaggtctgggatcagggagtcttcaaggcccccgctgaggggacagcgaatctaccattgaaccgtgcacgggggacatggacaaaatgagacgcgacagggacaagagcattttgctctgcttccaggaaacatcaagtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccggtttgtcttttgacaaccgagtggaactgacggggccggcgcctgccctgcgggtcccctcccttggctgagaagaaaaccaaataaaccttgaacagcct

SEQ ID NO: 357282 - DNA, 1504 bp, Homo sapiens
  misc_feature (1)..(1): n is a, c, g, or t
  misc_feature (11)..(11): n is a, c, g, or t
ntagctgcagnggctctcttaattaccccgctcaggctttggggagggggtgggagagacgacaggtctgggatcagggagtcttcaaggcccccgctgaggggacagcgaatctaccattgaaccgtgcacgggggacatggacaaaatgagacgcgacagggacaagagcattttgctctgcttccaggaaacatcaagttgcttgtctggagatggagccactacaggcgggcctgggcgcctggagtcgggcatgaaagaaaatagcgcctcatcgctcttatctaagcccagaggtccaggggacaacctgagggccctgaagtgtttcaataccatgtaccagcttgacttctctacatgtcctttggattgcccaaaagcaaaatctcagaggggccaaggaccttctagggctggctccctcagggcctcctatagagcagctccttgagtcgggccttatagccaccagaaagtcacctcgccgcaggaaagctataaagagctgctccagaggcgccgaaagagggtgagggctgcagccacagtgtttgtccccagcaccaccaggccccttaacctcgtcagctcctctagccctcggccagactctggcaacaccttggtttgcctggcaccgcaggcaatttcctggaaccccacccccacccaggaacggggaccacagcacctttaaaggaactgccagagcttcctcctacggcttgaaagcccaagctaatcagtaacccgtgagacaggggccaatattcaaacgctgcagcagaggcgcatagcctagccctggccaccccctcttgggaaggaggtcgagttaagccggtgtggagggtccaacaggaacggaaattacgacggtgtggttccttaaggatttggccccagtcccactaccaaatttttcccaaatcatatttaggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccgccgtttcctctccctcgccggcctcggcggagattccaggccctatagaaaccaggacgtcccttagcgccaccgcctcacatgccagtgctgccgggaacccagcgatatccgcaccagcggagaaggttccaggctgccggcggcggcgcagagagcgggaagagaggctcggaggaagccccgggcgtggcgtggtcaggctccgagagcggccgggatgcggccacaccggcctggtaaactcgcacctcttaggatcttgctcccggactcattcccttccccaccccctattttaaagttttatttgggtcgtctgtatcaatttagaacgagataaattaagacaaagaaagtaaaataaatcgaaataaaatataggaatagctcttggcga

SEQ ID NO: 357283 - DNA, 919 bp, Homo sapiens
caccacaaagaagtgtcccgtggtcaggtacactggggaaatggggctggttttgtttaaccgcaagtcttttcaggatgttggaagtgggcatacccatgggaatgagcaaggctgtttggtgtttctcaggtgtacctgatcacacagccctcggaggaccagcactctgaggaatgtatttttggggaagtgtaggtatcaggtccaggattttggatctcagtccatgttcatcctcaaagcccagtgatggtggtcatttcaggtgagctgggctggacctctgaaggaagcaaagattgtgagggttgctctcaagggtcttctgggcatgtttggaaaagtggacaagatggcggtgtcagcgaaaaagagcagggggcaggtgggcccctgggcaggagagggtggggggaaagggagccaggtgaggcacctgagaagttgtggcagcctcttagggacaaagctgaatttccctgagactagaaacctcttcttccgaaaactctgatactttttgtactgggcctatctcttgtcacttaggcaaattccttttcagttaatgggaccaaagagagatgtttttgcctccccctaagctggaggtagttggcttaaagtggaagaatcccgaggaggcggggacctggtaaggcccccatcattcagctgccctctcacacctgaagagccacttctctgctccaactgtggctggctttgtgttttgttttaaccaggaaggctgttccccgtgacctcaggggccacatcctgcttctgctgcctgccttgcctttgcaccctttgagtcagtgctgctcagccagcagcccctttctgagtcacagccacacagctgggccaaccgtgcgttggtttccttccccttagcaggacttagagaatc

SEQ ID NO: 357284 - DNA, 653 bp, Homo sapiens
cccaaaaccaaccaaacaaaaaaaaatatgattatgatcactgtactactctgtctcccctccaaatgccaggcagtgctctaggttttagggatgccaaagcttacagtccagtggcaaacacaaatgattaatgaaacaaacacagtaagtacagcatggagtaggctaggatacggaagtataaagtgctgcagagcccaggacagaaacacccaacctggccttggagtagtcagggaagacttcccagaagaaggtaagtctaggttaaggcctaactggtgaatgacctggctaggggagacagcggggtatttcagaccttgaggccaacatgaaaaaactgatggctgggagactgcgatgcctttgaaaaactgagagggccaagcgcagtggctcatgcctgtaattctagcattttggggggccgaggcgggtggatcacgaggtcaggagatcaagaccatcctggctaacatggtgaaaccctgtctctactaaaaatacaaaagataagctgggtgtggtggcgggcgcctgtagtcccagctactccagaagctgaggccagagaatggtgtgaacccgggaggcagagcttgcagtgaaccgagattgcgccactgcactccagcctgggggacaga

SEQ ID NO: 357285 - DNA, 470 bp, Homo sapiens
acagacaagccaccatgcctgattttctcattttcttagaaactggggcagggggtgtctcactatgttgcctgggctggttttgaactcctggcctcaagtgatcatcccacctcagcctcccaaagtgctgagattggagacatgagctaccgtgactggcctgttctttttttttaaagtaaataaggccgagcatggtgactcacccctgtaatcccagcacttttggtggctgaggtgggtggatcacctgaggtcaggagttcaagaccagcttgcccaacatggtgaaacgtcacctatcctaaaaatacaaaaataagctgggcgtggtggcagatgcctataaccacagctactctggagtctgatacaggagaatcacttgaacccaggaggtggtagttgaagtgagccgagatcatgccattgcattccagtttgggcaaaagagcaagattttgtct

SEQ ID NO: 357286 - DNA, 869 bp, Homo sapiens
cagcttcctctcgcactttcgccaggcaggcagcaggtgtgggcctggccccggctgggctgggccggaacctcacggaccgcacccaaccccagtaccgtgacatacgcaagtcgtgtaaatcaggagacaatgcagggaggtggatggaggcctgggctctggagccagactcccggctgtgtgacactgagctagtcagttagcctctctgggcctcacagccccaaaacagctgtgcccacctgagggttgtggtgagggttctgaagaagattgtggctaccacactgcagagctggaagctgttgtgggggcccagggcctggtggtgtgggcacatgccccacccatgtgctctcgggctgtggacccagcagcttccatcactgccaacagagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgagtggccaggccagagcc

SEQ ID NO: 357287 - DNA, 2723 bp, Homo sapiens
cggctggctgcggcggccggggaggccggggaggccgcggcgcggtcactgcgagccgagccgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacccccaggccatttactgcaaggatgttctggacattgaacagttctctacggtcaagggcgtggagctggagcctaccgaccaggacttctaccagaagtttgccacaggcagtgtgcccatcccctggcagaacgagatggtggagaccgagtgcttccaagagctgaatgtctttgggctggatggctcagttcccccagacctggactggaagggccagccacctgcacctcctaaaaagggactgctgcagagactcttcagtcgccaagattgctgtggaaactgcagcgacagcgaggaagagctccccacccgcctctagcccccagcccgaggcccccaccagcagttggcggtagcagctactccgagcgccgtttacagttttgcacagtgatcttccccattgtccactcaagtcgtggcctggggaacacagacggagctgtccccagtgtcctccgtccctcagcccctggcctggctgagtttggcagggcctgggccatccctgggacaaaggtgcgtcccttcagctcttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagccttcagcactgtgctggccaccccggcctctgagtaagactcgtgcctccccctgctgccctgggctcaggctgctaccctctggggcccaaagctgtcccttctcagtgcttgtcagcgctgggtctggggcctctgtatgccctaggcctgtgccaaagtggccagagattgggctgcctgtgatacccatcagcccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaa

SEQ ID NO: 357288 - DNA, 3149 bp, Homo sapiens
cggctggctgcggcggccggggaggccggggaggccgcggcgcggtcactgcgagccgagccgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggagcctgaagcaggagaagcacgtgtgtcctggaacgcagcaagggcgtgctggagcgtgcagagggaaggcctgaggtgctgttctgcctcggctctgccttggctgggccctagaggccgtggaccgcactgaggacccagaggcagttctgaggcagtgggactcgagacccagtgtcctattgctcccacaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacccccaggccatttactgcaaggatgttctggacattgaacagttctctacggtcaagggcgtggagctggagcctaccgaccaggacttctaccagaagtttgccacaggcagtgtgcccatcccctggcagaacgagatggtggagaccgagtgcttccaagagctgaatgtctttgggctggatggctcagttcccccagacctggactggaagggccagccacctgcacctcctaaaaagggactgctgcagagactcttcagtcgccaagattgctgtggaaactgcagcgacagcgaggaagagctccccacccgcctctagcccccagcccgaggcccccaccagcagttggcggtagcagctactccgagcgccgtttacagttttgcacagtgatcttccccattgtccactcaagtcgtggcctggggaacacagacggagctgtccccagtgtcctccgtccctcagcccctggcctggctgagtttggcagggcctgggccatccctgggacaaaggtgcgtcccttcagctcttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagccttcagcactgtgctggccaccccggcctctgagtaagactcgtgcctccccctgctgccctgggctcaggctgctaccctctggggcccaaagctgtcccttctcagtgcttgtcagcgctgggtctggggcctctgtatgccctaggcctgtgccaaagtggccagagattgggctgcctgtgatacccatcagcccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaataatccgccccttcctgtgtgcgcctgtggggtgcgtgcgcgcgcgtgtgtacctgtgtgggtgaaggggatagggcgaggctgtgcctgtgccccaggtcccagccctggcccttcccagactgtgatggccatcctggtcccagtgttagggtagcatgggattacagggccctgttttttccatatttaaagccaatttttattactcgttttgtccaacgtaaaag

SEQ ID NO: 357289 - DNA, 2659 bp, Homo sapiens
cggctggctgcggcggccggggaggccggggaggccgcggcgcggtcactgcgagccgagccgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacccccaggccatttactgcaaggatgttctggacattgaacagttctctacggtcaagggcgtggagctggagcctaccgaccaggacttctaccagaagtttgccacaggcagtgtgcccatcccctggcagaacgagatggtggagaccgagtgcttccaagagctgaatgtctttgggctggatggctcagttcccccagacctggactggaagggccagccacctgcacctcctaaaaagggactgctgcagagactcttcagtcgccaagattgctgtggaaactgcagcgacagcgaggaagagctccccacccgcctctagcccccagcccgaggcccccaccagcagttggcggtagcagctactccgagcgccgtttacagttttgcacagtgatcttccccattgtccactcaagtcgtggcctggggaacacagacggagctgtccccagtgtcctccgtccctcagcccttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagccttcagcactgtgctggccaccccggcctctgagtaagactcgtgcctccccctgctgccctgggctcaggctgctaccctctggggcccaaagctgtcccttctcagtgcttgtcagcgctgggtctggggcctctgtatgccctaggcctgtgccaaagtggccagagattgggctgcctgtgatacccatcagcccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaa

SEQ ID NO: 357290 - DNA, 1851 bp, Homo sapiens
cggctggctgcggcggccggggaggccggggaggccgcggcgcggtcactgcgagccgagccgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacccccaggccatttactgcaaggatgttctggacattgaacagttctctacggtcaagggcgtggagctggagcctaccgaccaggacttccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaa

SEQ ID NO: 357291 - DNA, 1784 bp, Homo sapiens
cggctggctgcggcggccggggaggccggggaggccgcggcgcggtcactgcgagccgagccgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacgggcctgggccatccctgggacaaaggtgcgtcccttcagctcttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagccttcagcactgtgctggccaccccggcctctgagtaagactcgtgcctccccctgctgccctgggctcaggctgctaccctctggggcccaaagctgtcccttctcagtgcttgtcagcgctgggtctggggcctctgtatgccctaggcctgtgccaaagtggccagagattgggctgcctgtgatacccatcagcccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaa

SEQ ID NO: 357292 - DNA, 714 bp, Homo sapiens
cgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggtgaggcggccgggtgggcggccgggcccgggtgcgtggagcgcgagtgcgctgcgtctgagctccgcagggctacccagccgtcggatcccctaggcccgcgggccctgcgccttacaccccgcccagacacgagcctttccggcccgtcgtcttcctcctccgcacctgcccccgggattcggggcccaggaaggggcgggggtcaggccgccgccctcgcggcgggtgggggtgaaggagtgaaagaaggtgagacgaagagggaagggtgggaccggagccccaggagagcctgtctgagaggcaagcctcctccaggggagaggtgtaaagatgccccacgtgccaggggcccagaccccagcaccctagcctaatcccgcgcaaagttggcgataggtaaagctggagaatgaataaacggaccctctgcgtagcacagcccacctgacttggggaaactcctggccacaaatgctacttataggactgccacttgctccgtgcctcaggacactgagggcagaggtgaatggatatttgccctcagggagcccatg

SEQ ID NO: 357293 - DNA, 2953 bp, Homo sapiens
cggctggctgcggcggccggggaggccggggaggccgcggcgcggtcactgcgagccgagccgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacccccaggccatttactgcaaggatgttctggacattgaacagttctctacggtcaagggcgtggagctggagcctaccgaccaggacttctaccagaagtttgccacaggcagtgtgcccatcccctggcagaacgagatggtggagaccgagtgcttccaagagctgaatgtctttgggctggatggctcagttcccccagacctggactggaagggccagccacctgcacctcctaaaaagggactgctgcagagactcttcagtcgccaagattgctgtggaaactgcagcgacagcgaggaagagctccccacccgcctctagcccccagcccgaggcccccaccagcagttggcggtagcagctactccgagcgccgtttacagttttgcacagtgatcttccccattgtccactcaagtcgtggcctggggaacacagacggagctgtccccagtgtcctccgtccctcagcccctggcctggctgagtttggcagggcctgggccatccctgggacaaaggtgcgtcccttcagctcttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagccttcagcactgtgctggccaccccggcctctgagtaagactcgtgcctccccctgctgccctgggctcaggctgctaccctctggggcccaaagctgtcccttctcagtgcttgtcagcgctgggtctggggcctctgtatgccctaggcctgtgccaaagtggccagagattgggctgcctgtgatacccatcagcccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaataatccgccccttcctgtgtgcgcctgtggggtgcgtgcgcgcgcgtgtgtacctgtgtgggtgaaggggatagggcgaggctgtgcctgtgccccaggtcccagccctggcccttcccagactgtgatggccatcctggtcccagtgttagggtagcatgggattacagggccctgttttttccatatttaaagccaatttttattactcgttttgtccaacgtaaaag

SEQ ID NO: 357294 - DNA, 2915 bp, Homo sapiens
cggctggctgcggcggccggggaggccggggaggccgcggcgcggtcactgcgagccgagccgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacccccaggccatttactgcaaggatgttctggacattgaacagttctctacggtcaagggcgtggagctggagcctaccgaccaggacttctaccagaagtttgccacaggcagtgtgcccatcccctggcagaacgagatggtggagaccgagtgcttccaagagctgaatgtctttgggctggatggctcagttcccccagacctggactggaagggccagccacctgcacctcctaaaaagggactgctgcagagactcttcagtcgccaagattgctgtggaaactgcagcgacagcgaggaagagctccccacccgcctctagcccccagcccgaggcccccaccagcagttggcggtagcagctactccgagcgccgtttacagttttgcacagtgatcttccccattgtccactcaagtcgtggcctggggaacacagacggagctgtccccagtgtcctccgtccctcagcccctggcctggctgagtttggcagggcctgggccatccctgggacaaaggtgcgtcccttcagctcttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagccttcagcactgtgctggccaccccggcctctgagtaagactcgtgcctccccctgctgccctgggctcaggctgctaccctctggggcccaaagctgtcccttctcagtgcttgtcagcgctgggtctggggcctctgtatgccctaggcctgtgccaaagtggccagagattgggctgcctgtgatacccatcagcccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaaaaaaaaaaaaaaaacaaaaaaaaaccccggggacctcaattgttcggggtggggaaaaaggggctacggaaggggcccaggggcaaaagcgggatcccagagaccccagctacgtggcacaagggggaaaatcggcgagtctccctataggagagcccaataactccgaaaagccggggtaccggcatagag

SEQ ID NO: 357295 - DNA, 1946 bp, Homo sapiens
cggctggctgcggcggccggggaggccggggaggccgcggcgcggtcactgcgagccgagccgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacccccaggccatttactgcaaggatgttctggacattgaacagttctctacggtcaagggcgtggagctggagcctaccgaccaggacttctaccagaagtttgccacaggcagtgtgcccatcccctggcagaacgagatggtggagaccgagtgcttccaagagctgaatgtctttgggctggatggctcagttcccccagacctggactggaagggccagccacctgcacctcctaaaaagggactgctgcagagactcttcagtcgccaaaggtgagcagtgtgggctccccgtgggttggccttgctgcctggcctcggggagccacgggcagcccttccatggcaaaggcaagatgtgggagaaagaagtctggtgc

SEQ ID NO: 357296 - DNA, 1951 bp, Homo sapiens
cggctggctgcggcggccggggaggccggggaggccgcggcgcggtcactgcgagccgagccgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgagggccagaccatcaaagggcgtgtgggcaccgtgggttacatggctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacgtgagtgcagcccactcctgctgagggcggggcccagccagggctggggctcaggggctcttgtagtatcagccaggatgcttccagtgcaagtggcagaaaaaacaatctagtggcttagccacagaaataaagataattcacaaaaaggaaaagccccaggatgggtctggcttgtggcatgcctggatggggcttggagcctctgacaatgtcctaggaactctctctccttcccctcactgtaccgttgagtgtgtagtcttcatattggggtagctctccccatggtgcggcagcagtgggccccagcagctcagccaccacagtagacagagagcttctcttctcttttctcttctcctctcctctccttccttccttcgt

SEQ ID NO: 357297 - DNA, 1420 bp, Homo sapiens
cggctggctgcggcggccggggaggccggggaggccgcggcgcggtcactgcgagccgagccgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgaggtcccccggcagctggtgacgaactgcacccagcggctggagcagggtccctgcaaagaccttttccaggaactcacccggctgacccacgagtacctgagcgtggccccttttgccgactacctcgacagcatctacttcaaccgtttcctgcagtggaagtggctggaaaggcagccagtgaccaaaaacaccttcaggcaataccgagtcctgggcaaaggtggctttggggaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggaaagtcagccagtgaccaaatacaccttcaggcaataccgagtcctgggcaaaggtggctttggggaggtgtgcccctgcccggtgcgcgccacaggtaagatgtatgcctgcaagaagctagagaaaaagcggatcaagaagcggaaaggggaggccctggcgctgaacgagaagcagatcctggagaaagtgaacagtaggtttgtagtgagcttggcctacgcctatgagaccaaggacgcggtgtgcctggtgctgacactgatgaacggggcgactcaagttccacagtccgtactg

SEQ ID NO: 357298 - DNA, 803 bp, Homo sapiens
cggctggctgcggcggccggggaggccggggaggccgcggcgcggtcactgcgagccgagccgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggtggcggtggaaatcgcaaaggcaaaagcaagaaatggcggcagatgctccagttccctcacatcagccagtgcgaagagctgcggctcagcctcgagcgtgactatcacagcctgtgcgagcggcagcccattgggcgcctgctgttccgagagttctgtgccacgaggccggagctgagccgctgcgtcgccttcctggatggggtggccgagtatgaagtgaccccggatgacaagcggaaggcatgtgggcggcagctaacgcagaattttctgagccacacgggtcctgacctcatccctgagtcatatagctctgcctcattctgtgtgtgtgtgcatgtgtgtgttagcagaggtattttactcagaaaataggtttcaaagaacattaatgactttcttttcccttttatgtctgcttaatcagtgttaaactgctatgggaaaagttttatagaactatataacctgaatgttggtctctttgtacacatcttttctatgactgcaaatcttcactttatgtatcatttttactgtcatattatttttgttcaataaaaactttgtgataaaaggtgaaaaa

SEQ ID NO: 357299 - DNA, 2691 bp, Homo sapiens
tccggaactgcagtatccacctggggcttaaaaaccacctgagactccatttcccggcgtgctttaaaaatcgctttacacctgcaatgcggtgagggcgtggcgacgactccatttcccggcttgcctcacggcccgagacccgcaggttcacgcgggccgactcaatttcccagagcgcaccgagctctgggaggcatacacagctaatagactgagtgagtggactccgtttcccagcgtgcatcaggctctctgcttcctaaagtgcttcagggctccccgtcgtacagtcggctgacagattaccctggactccatttcccgacgtacagcgtgacccgtcattcccgcccatcattcccgcggtctactctgaggcttttgtggacttcatttcccggcgtgccacgcggctctctgtgcgggccgagggcggtgacggcggcgcggacgacagccggactgcatctcccggcgtgccccgcggcgggcgctgggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggacccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttgtaaatagaaccagcccagcccgtctcctcttcccttccctggcccccgggtgtaaatagattgttataatttttttcttaaagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctg

SEQ ID NO: 357300 - DNA, 1787 bp, Homo sapiens
  misc_feature (1731)..(1731): n is a, c, g, or t
  misc_feature (1738)..(1738): n is a, c, g, or t
  misc_feature (1753)..(1753): n is a, c, g, or t
  misc_feature (1761)..(1761): n is a, c, g, or t
tccggaactgcagtatccacctggggcttaaaaaccacctgagactccatttcccggcgtgctttaaaaatcgctttacacctgcaatgcggtgagggcgtggcgacgactccatttcccggcttgcctcacggcccgagacccgcaggttcacgcgggccgactcaatttcccagagcgcaccgagctctgggaggcatacacagctaatagactgagtgagtggactccgtttcccagcgtgcatcaggctctctgcttcctaaagtgcttcagggctccccgtcgtacagtcggctgacagattaccctggactccatttcccgacgtacagcgtgacccgtcattcccgcccatcattcccgcggtctactctgaggcttttgtggacttcatttcccggcgtgccacgcggctctctgtgcgggccgagggcggtgacggcggcgcggacgacagccggactgcatctcccggcgtgccccgcggcgggcgctgggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggacccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggnttcattntgaagcgcaaagaanggcctgtntacgtgggaaccacctaggtccccac

SEQ ID NO: 357301 - DNA, 507 bp, Homo sapiens
gtagcctggccccgttgtacagttgcggtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaggtgtacatgtaccagctcttccgcaactgtacggcgggcccgccgtaccagttgcgcatccaaactctacatttacaaaacgaattcagggtgaggaagtaaaaacaggtcatctattcacaaa

SEQ ID NO: 357302 - DNA, 1932 bp, Homo sapiens
aggggagaggctctgagaggcgaggccgggtgaggcggcgagggcggcccgacgggcgcgggacgggacggggcagcgagggcgccgggagccgcggcccggaatcggggcgcttcgccccgggccccccagcatgaagaccccggcggacacaggtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttgtaaatagaaccagcccagcccgtctcctcttcccttccctggcccccgggtgtaaatagattgttataatttttttcttaaagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctg

SEQ ID NO: 357303 - DNA, 1778 bp, Homo sapiens
gtagcctggccccgttgtacagttgcggtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttgtaaatagaaccagcccagcccgtctcctcttcccttccctggcccccgggtgtaaatagattgttataatttttttcttaaagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctg

SEQ ID NO: 357304 - DNA, 1452 bp, Homo sapiens
taatgaggtcgggtgccgcacttcataaggcagtgacatccctatcctctatgtcgaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttgtaaatagaaccagcccagcccgtctcctcttcccttccctggcccccgggtgtaaatagattgttataatttttttcttaaagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctg

SEQ ID NO: 357305 - DNA, 2646 bp, Homo sapiens
tccggaactgcagtatccacctggggcttaaaaaccacctgagactccatttcccggcgtgctttaaaaatcgctttacacctgcaatgcggtgagggcgtggcgacgactccatttcccggcttgcctcacggcccgagacccgcaggttcacgcgggccgactcaatttcccagagcgcaccgagctctgggaggcatacacagctaatagactgagtgagtggactccgtttcccagcgtgcatcaggctctctgcttcctaaagtgcttcagggctccccgtcgtacagtcggctgacagattaccctggactccatttcccgacgtacagcgtgacccgtcattcccgcccatcattcccgcggtctactctgaggcttttgtggacttcatttcccggcgtgccacgcggctctctgtgcgggccgagggcggtgacggcggcgcggacgacagccggactgcatctcccggcgtgccccgcggcgggcgctgggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggacccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttcccgggtgtaaatagattgttataatttttttcttaaagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctg

SEQ ID NO: 357306 - DNA, 1228 bp, Homo sapiens
tgaggaataaaagcattgggaggttggtggccctactcgcctagccctgacgctccctccatttcccctcagatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttgtaaatagaaccagcccagcccgtctcctcttcccttccctggcccccgggtgtaaatagattgttataatttttttcttaaagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctg

SEQ ID NO: 357307 - DNA, 2115 bp, Homo sapiens
tccggaactgcagtatccacctggggcttaaaaaccacctgagactccatttcccggcgtgctttaaaaatcgctttacacctgcaatgcggtgagggcgtggcgacgactccatttcccggcttgcctcacggcccgagacccgcaggttcacgcgggccgactcaatttcccagagcgcaccgagctctgggaggcatacacagctaatagactgagtgagtggactccgtttcccagcgtgcatcaggctctctgcttcctaaagtgcttcagggctccccgtcgtacagtcggctgacagattaccctggactccatttcccgacgtacagcgtgacccgtcattcccgcccatcattcccgcggtctactctgaggcttttgtggacttcatttcccggcgtgccacgcggctctctgtgcgggccgagggcggtgacggcggcgcggacgacagccggactgcatctcccggcgtgccccgcggcgggcgctgggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggacccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggcctctagcggcaaccggggtaaaagctcg

SEQ ID NO: 357308 - DNA, 2258 bp, Homo sapiens
tccggaactgcagtatccacctggggcttaaaaaccacctgagactccatttcccggcgtgctttaaaaatcgctttacacctgcaatgcggtgagggcgtggcgacgactccatttcccggcttgcctcacggcccgagacccgcaggttcacgcgggccgactcaatttcccagagcgcaccgagctctgggaggcatacacagctaatagactgagtgagtggactccgtttcccagcgtgcatcaggctctctgcttcctaaagtgcttcagggctccccgtcgtacagtcggctgacagattaccctggactccatttcccgacgtacagcgtgacccgtcattcccgcccatcattcccgcggtctactctgaggcttttgtggacttcatttcccggcgtgccacgcggctctctgtgcgggccgagggcggtgacggcggcgcggacgacagccggactgcatctcccggcgtgccccgcggcgggcgctgggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggacccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctg

SEQ ID NO: 357309 - DNA, 1117 bp, Homo sapiens
tccttagtggttgggccttagtttcttcatttggaaggtgggggtgtgggaagcaaccagtcataacttgccgcaggcactgtggcagtgagataacaggagtatgccagtgtccagggcatctcaccctcatgagccctgcacccatccctcaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttgtaaatagaaccagcccagcccgtctcctcttcccttccctggcccccgggtgtaaatagattgttataatttttttcttaaagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctg

SEQ ID NO: 357310 - DNA, 878 bp, Homo sapiens
tggagcctggcactctggtgtgtcactcagttactatcgtggccctttagcacttgagtttgcaacccttcacctaaagtaacagcttgtaacttttaatgtagcatctatgacaagagaattcctacttttgggttgggcgaaggggtgtctgaaaggcaaaggctaactctgctccttccctgcctccctccagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttgtaaatagaaccagcccagcccgtctcctcttcccttccctggcccccgggtgtaaatagattgttataatttttttcttaaagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctg

SEQ ID NO: 357311 - DNA, 771 bp, Homo sapiens
ggcctcatcatcaaaatcgatcatcatcatcatcttgcatcatcatcctcttcagtcatcatcgtcatcatcgtgtcatcagcagcaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttgtaaatagaaccagcccagcccgtctcctcttcccttccctggcccccgggtgtaaatagattgttataatttttttcttaaagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctg

SEQ ID NO: 357312 - DNA, 1487 bp, Homo sapiens
tccggaactgcagtatccacctggggcttaaaaaccacctgagactccatttcccggcgtgctttaaaaatcgctttacacctgcaatgcggtgagggcgtggcgacgactccatttcccggcttgcctcacggcccgagacccgcaggttcacgcgggccgactcaatttcccagagcgcaccgagctctgggaggcatacacagctaatagactgagtgagtggactccgtttcccagcgtgcatcaggctctctgcttcctaaagtgcttcagggctccccgtcgtacagtcggctgacagattaccctggactccatttcccgacgtacagcgtgacccgtcattcccgcccatcattcccgcggtctactctgaggcttttgtggacttcatttcccggcgtgccacgcggctctctgtgcgggccgagggcggtgacggcggcgcggacgacagccggactgcatctcccggcgtgccccgcggcgggcgctgggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggacccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgcctggagggccaggggagtggagagagctcctgatgtcttagtttccacagtaaggtttgcctgtgtacagacctccgttcaataaattattggcatgaaaacctg

SEQ ID NO: 357313 - DNA, 263 bp, Homo sapiens
gacatcaagccccagaacctgctggtggaccctgacactgctgtcctcaagctctgcgattttggcaggtgggcctggggcatgttgggtggctgaagaggcaggggggaccccaacccttgcctcacgtgtacccctgcccatctcttcccacagtgcaaagcagttggtccgaggggagcccaatgtctcctacatctgttctcgctactaccgggccccagagctcatctttggagccactgattacacctcatccatcg

SEQ ID NO: 357314 - DNA, 190 bp, Homo sapiens
gggttcccatttggtgcccatcataaccctgctgtagtctaccctgactagcatgtcaattcctgtttctagaactctccatccaaccgtctctcaacgccattctcatccctcctcacttgaggtccccagcgggcactaccaccctcaccccgtcctcacaaggtaagtggggaccatctgctggggg

SEQ ID NO: 357315 - DNA, 1731 bp, Homo sapiens
tccggaactgcagtatccacctggggcttaaaaaccacctgagactccatttcccggcgtgctttaaaaatcgctttacacctgcaatgcggtgagggcgtggcgacgactccatttcccggcttgcctcacggcccgagacccgcaggttcacgcgggccgactcaatttcccagagcgcaccgagctctgggaggcatacacagctaatagactgagtgagtggactccgtttcccagcgtgcatcaggctctctgcttcctaaagtgcttcagggctccccgtcgtacagtcggctgacagattaccctggactccatttcccgacgtacagcgtgacccgtcattcccgcccatcattcccgcggtctactctgaggcttttgtggacttcatttcccggcgtgccacgcggctctctgtgcgggccgagggcggtgacggcggcgcggacgacagccggactgcatctcccggcgtgccccgcggcgggcgctgggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggacccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgagtactagtggcgcccgtgtagggtggtgattagggttcccaaagctcctcagacatccatcagattctttcatgtgcttagataggagctcgaggtcactgtgcctccccataccggggatccgagccctcttcctcccaggaaaaggagtcttggggttaccatctcttggagatcagaattactcgtggatcagaattactaacacttaaagaaacgggttacaagtctctgttcttccattattgaggtcttgggtccttgagccttaagaacaggtatctgatgttgctattcattataatattggatcagaggtcacagtcgcttgcaaatggggatctagggttattgtctcctaagagaacaagaataagaccaaccccgaaaaagagggatctgcattcgctgtccttcagaagatggggatttggagcgaatatcacttagaagcagggctttgaggttactgtgttttgtccccaaagaatagggccaggctttccaaacctggtactcagatcatcttccctattaaaaccaagacctggcatcattacccaccctaaatcttgttgagctgtactgccaatggtgagaattaatagttactgccttttagatataaagacattgggagtcagcatatccttcaaaccaagtccatagtccatgttttaaaatacatggcttggtgtgtctcctttaacaaaaatggaatggagcagggtaggtcacagtttcctacagaatatggatctaaggttatacttttttaataattgttctaaggtatggtgtcattggctctga

SEQ ID NO: 357316 - DNA, 2065 bp, Homo sapiens
atcaggcgaagactgtggggccaatctgtggagcctcttgacagcctctgtttccctgggagtggcagtggccggccctggctcaggacagggagttgtgaggatcaaatgaatggacggttgcaaaaagtgacaggaacattcactaccattactcactgggagcaggactctcgattttacagcccactcgaccacagtcttcgcctgatcgaagactgtggggtcgtgtaccaggcacggctggcagagaccagggatggatcgtgtatcccctttgttccccaggtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttgtaaatagaaccagcccagcccgtctcctcttcccttccctggcccccgggtgtaaatagattgttataatttttttcttaaagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctg

SEQ ID NO: 357317 - DNA, 2854 bp, Homo sapiens
tccggaactgcagtatccacctggggcttaaaaaccacctgagactccatttcccggcgtgctttaaaaatcgctttacacctgcaatgcggtgagggcgtggcgacgactccatttcccggcttgcctcacggcccgagacccgcaggttcacgcgggccgactcaatttcccagagcgcaccgagctctgggaggcatacacagctaatagactgagtgagtggactccgtttcccagcgtgcatcaggctctctgcttcctaaagtgcttcagggctccccgtcgtacagtcggctgacagattaccctggactccatttcccgacgtacagcgtgacccgtcattcccgcccatcattcccgcggtctactctgaggcttttgtggacttcatttcccggcgtgccacgcggctctctgtgcgggccgagggcggtgacggcggcgcggacgacagccggactgcatctcccggcgtgccccgcggcgggcgctgggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggacccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttgtaaatagaaccagcccagcccgtctcctcttcccttccctggcccccgggtgtaaatagattgttataatttttttcttaaagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctgctttctgtccggctgcctgtttccgctgaggtggtgggggcttccggtggggggactgttctgggacgggagtgagctgcatctcaggcagagggctgtccgaaggccctggctcaggtgcccaaccttctcacaccgtggctttctctgcacgtgtggtgat

SEQ ID NO: 357318 - DNA, 2591 bp, Homo sapiens
tccggaactgcagtatccacctggggcttaaaaaccacctgagactccatttcccggcgtgctttaaaaatcgctttacacctgcaatgcggtgagggcgtggcgacgactccatttcccggcttgcctcacggcccgagacccgcaggttcacgcgggccgactcaatttcccagagcgcaccgagctctgggaggcatacacagctaatagactgagtgagtggactccgtttcccagcgtgcatcaggctctctgcttcctaaagtgcttcagggctccccgtcgtacagtcggctgacagattaccctggactccatttcccgacgtacagcgtgacccgtcattcccgcccatcattcccgcggtctactctgaggcttttgtggacttcatttcccggcgtgccacgcggctctctgtgcgggccgagggcggtgacggcggcgcggacgacagccggactgcatctcccggcgtgccccgcggcgggcgctgggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggacccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttgtaaatagaaccagcccagcccgtctcctcttcccttccctggcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctg

SEQ ID NO: 357319 - DNA, 2396 bp, Homo sapiens
tccggaactgcagtatccacctggggcttaaaaaccacctgagactccatttcccggcgtgctttaaaaatcgctttacacctgcaatgcggtgagggcgtggcgacgactccatttcccggcttgcctcacggcccgagacccgcaggttcacgcgggccgactcaatttcccagagcgcaccgagctctgggaggcatacacagctaatagactgagtgagtggactccgtttcccagcgtgcatcaggctctctgcttcctaaagtgcttcagggctccccgtcgtacagtcggctgacagattaccctggactccatttcccgacgtacagcgtgacccgtcattcccgcccatcattcccgcggtctactctgaggcttttgtggacttcatttcccggcgtgccacgcggctctctgtgcgggccgagggcggtgacggcggcgcggacgacagccggactgcatctcccggcgtgccccgcggcgggcgctgggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggacccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctg

SEQ ID NO: 357320 - DNA, 2233 bp, Homo sapiens
tccggaactgcagtatccacctggggcttaaaaaccacctgagactccatttcccggcgtgctttaaaaatcgctttacacctgcaatgcggtgagggcgtggcgacgactccatttcccggcttgcctcacggcccgagacccgcaggttcacgcgggccgactcaatttcccagagcgcaccgagctctgggaggcatacacagctaatagactgagtgagtggactccgtttcccagcgtgcatcaggctctctgcttcctaaagtgcttcagggctccccgtcgtacagtcggctgacagattaccctggactccatttcccgacgtacagcgtgacccgtcattcccgcccatcattcccgcggtctactctgaggcttttgtggacttcatttcccggcgtgccacgcggctctctgtgcgggccgagggcggtgacggcggcgcggacgacagccggactgcatctcccggcgtgccccgcggcgggcgctgggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggacccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctg

SEQ ID NO: 357321 - DNA, 1749 bp, Homo sapiens
tccggaactgcagtatccacctggggcttaaaaaccacctgagactccatttcccggcgtgctttaaaaatcgctttacacctgcaatgcggtgagggcgtggcgacgactccatttcccggcttgcctcacggcccgagacccgcaggttcacgcgggccgactcaatttcccagagcgcaccgagctctgggaggcatacacagctaatagactgagtgagtggactccgtttcccagcgtgcatcaggctctctgcttcctaaagtgcttcagggctccccgtcgtacagtcggctgacagattaccctggactccatttcccgacgtacagcgtgacccgtcattcccgcccatcattcccgcggtctactctgaggcttttgtggacttcatttcccggcgtgccacgcggctctctgtgcgggccgagggcggtgacggcggcgcggacgacagccggactgcatctcccggcgtgccccgcggcgggcgctgggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggacccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtggggcagggctaggggct

SEQ ID NO: 357322 - DNA, 1420 bp, Homo sapiens
tccggaactgcagtatccacctggggcttaaaaaccacctgagactccatttcccggcgtgctttaaaaatcgctttacacctgcaatgcggtgagggcgtggcgacgactccatttcccggcttgcctcacggcccgagacccgcaggttcacgcgggccgactcaatttcccagagcgcaccgagctctgggaggcatacacagctaatagactgagtgagtggactccgtttcccagcgtgcatcaggctctctgcttcctaaagtgcttcagggctccccgtcgtacagtcggctgacagattaccctggactccatttcccgacgtacagcgtgacccgtcattcccgcccatcattcccgcggtctactctgaggcttttgtggacttcatttcccggcgtgccacgcggctctctgtgcgggccgagggcggtgacggcggcgcggacgacagccggactgcatctcccggcgtgccccgcggcgggcgctgggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggacccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaggtgtacatgtaccagctcttccgcaactgtacggcgggcccgccgtaccagttgcgcatccaaactctacatttacaaaacgaattcagggtgaggaagtaaaaacaggtcatctattcacaaa

SEQ ID NO: 357323 - DNA, 369 bp, Homo sapiens
tcaagattccaatttttatggagggtcagcagggctcatatagtcccagacctgggctgcctgcttacccgatacaaactgacctctccttagtggttgggccttagtttcttcatttggaaggtgggggtgtgggaagcaaccagtcataacttgccgcaggcactgtggcagtgagataacaggagtatgccagtgtccagggcatctcaccctcatgagccctgcacccatccctcaggtgttcaaatctcgaacgccgccagaggccatcgcgctctgctctagcctgctggagtacaccccatcctcaaggctctccccactagaggcctgtgcgcacagcttctttgatgaactgcgatgtct

SEQ ID NO: 357324 - DNA, 674 bp, Homo sapiens
aagtaacatacaatggagctcccattcatctggcagcagactttacagtggaagactaacaggacaggagagagtgatgttacatatttaaagtgctgaaggcaaaaaaaaagaaaagtacaatatgcatgtttattagtctgaatataaattagtacctttaccattttccagacaatgctaagatctctgagcactttaaccccactcaaccctttttactttttgtgttagaaccatgcattataaacctacatatattattatgtatatgcatgttatatttaagaagacattagtatttatttatagtcaaaatgaatttagaaatacatctttatcctttctcttattctttgtccctttctcttattctttgttctgtactgtatttccatgtttctttttgaaattatttttattcttcctttagtatttcctttactgcaggtctgctgcgatatattttctcagttttgatggtctgaaatatctttattttgcctgtacttttgaataatattttcactgggtatagaattctaagtggacagttctgttttttccatattttaaaatgtcactgcatcaccatctggcttccattgttccattgagaaatcagctttcagtcttactatcaatcttttcatgctatcatgtctttctctcta

SEQ ID NO: 357325 - DNA, 354 bp, Homo sapiens
acaaacaaagtaacttggggttactttgtttattttgtgatatattttgttattccttgtgacatactgtatttccatgtttctttttgaaattatttttattcttcctttagtatttcctttactgcaggtctgctgcgatatattttctcagttttgatggtctgaaatatctttattttgcctgtacttttgaataatattttcactgggtatagaattctaagtggacagttctgttttttccatattttaaaatgtcactgcatcaccatctggcttccattgttccattgagaaatcagctttcagtcttactatcaatcttttcatgctatcatgtctttctctcta

SEQ ID NO: 357326 - DNA, 968 bp, Homo sapiens
  misc_feature (741)..(741): n is a, c, g, or t
  misc_feature (748)..(748): n is a, c, g, or t
  misc_feature (752)..(752): n is a, c, g, or t
gggtgactggctgtgactcaggacccagaggagtagagggagccaggcaggggtccctccacctcggggaagagctggatgggctcttcgggagctcagaaaggctaagccttgagggacggtgacgcagagccgcctgcctgcccgggcctctgcatacctgggatcggggtgaaggacctttgcctcctagaggcctgcctgagccggggctggtggttggaaggctgctgcggcggcccacggtgccccacagcaggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggacncgtctgnaganatggcctgaaccagacaacgtgtccggtggccaagcaaacgaccggcggtgacaaatcgagagccgagcactgggcacacgaacatgcggcaggcaggaagaaggggagacccaccagaggtgccgaggcgccaacacactaacggagacaaggatgacaagccgaggcaaaacaacaggaagaaggacgccggagcaacccaggacgacaaaaca

SEQ ID NO: 357327 - DNA, 512 bp, Homo sapiens
cccactgatacacaaataggcaggtacgaggctgggtggtgaataggcagaggcccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccactgatgtgtgcatgattgtgacta

SEQ ID NO: 357328 - DNA, 3700 bp, Homo sapiens
gaggcagccgtccgggcccggagaggcggggaactacacgtcccggcgggcgcagcggcctggcgcttccggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgacctgctcttcagtggctcctctgacaagaccatcaaggtgtgggacacatgtaccacctacaagtgtcagaagacactggagggccatgatggcatcgtgctggctctctgcatccaggggtgcaaactctacagcggctctgcagactgcaccatcattgtgtgggacatccagaacctgcagaaggtgaacaccatccgggcccatgacaacccggtgtgcacgctggtctcctcacacaacgtgctcttcagcggctccctgaaggccatcaaggtctgggacatcgtgggcactgagctgaagttgaagaaggagctcacaggcctcaaccactgggtgcgggccctggtggctgcccagagctacctgtacagcggctcctaccagacaatcaagatctgggacatccgaacccttgactgcatccacgtcctgcagacgtctggtggcagcgtctactccattgctgtgacaaatcaccacattgtctgtggcacctacgagaacctcatccacgtgtgggacattgagtccaaggagcaggtgcggaccctcacgggccacgtgggcaccgtgtatgccctggcggtcatctcgacgccagaccagaccaaagtcttcagtgcatcctacgaccggtccctcagggtctggagtatggacaacatgatctgcacgcagaccctgctgcgtcaccagggcagtgtcaccgcgctggctgtgtcccggggccgactcttctcaggggctgtggatagcactgtgaaggtttggacttgctaacaggatccaggccaggctgtggtttcccctgaaccagccctggacctttctgagccaggctggccacatggggtggtctcggggtttctgcctgccccgtgggcataggtggacaggctctggcagccgggcagtgccctccccgtcccatgctcggcgagcctccctctactcggcactgtccttgctgcccagcccctctctgggtgccaggtacgacgcttgccccggcccaccctccatccccaccctccatccccaccctagatggagcgagggcctttttactcaccttttctaccgtttttagactgtatgtagatttggttacctcctggttgaaataaatgctccacagactgtggctgtgagtggggacagctcctcgggacaagggggctgtgtgtggccttgaggttggtgtgcacaggcactggctgctgtgagtgggggggcatggggcagtttcctttggtggaccccaggacttcggcccactccggggcctcccctccctgctaggaggcaactcgtcacacccaagctgctggcctccagtcccatctcccccaacacatgtgcccccaaaaagtgagccaggcacctctgtttcctgctgtttattgacagccgacggcagcgccttgcccagacctcccctgcccacctgctggagcccagcctgtgccgccctctgaggagaggcctggggggacagctgggcacgtccactcgcagggaaacacggggtgagacagcaggaaggggccctgcacgccgggacgccacctccgccagccgcctccacccgccccacaccacaatcgctggttttcggcattttttaaattttttttttaagaaacgtcaaagttgtgcccaacactgtggatcagcaaacacgatagaggagaccagtcagtacttcttggagggggcaggaggagagaggaaaagggagggcgagaatgaccacacaacacagccttggaccatgagcagaagcgtccgtgggaactccactggggtggatgggctgcctgcacagcccctggagagggggccaggcacaccctcagaggagctgcaagcccgtggcctggcctgctacatgccctgcttccacgtggctgccacgctgacacacccacattcaccaaacccacccgcgccctgggacgcagccacgccaggaggaggacacggccgccgagagcaaggcacaacctcgagttcttggggcgcagagaacttaggagagaagcacggaggagcccccggcagagcacccgcccccgggccccagccttccacctgtgctagcagcctggggcctccactctggccggaggaaggaccgcaggcagacagcctgggcctctaacagcttttgtccggagctagacttcgtgtcctttcagttggtaaatggttttctatagaatcaataatatttctttctttaaatatatatttgttaaagtta

SEQ ID NO: 357329 - DNA, 3507 bp, Homo sapiens
aatatttttaatgtttaatagttaagacccgggagcaatttttctgtgaaagggccacccatcttcccaccccaaacttcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgacctgctcttcagtggctcctctgacaagaccatcaaggtgtgggacacatgtaccacctacaagtgtcagaagacactggagggccatgatggcatcgtgctggctctctgcatccaggggtgcaaactctacagcggctctgcagactgcaccatcattgtgtgggacatccagaacctgcagaaggtgaacaccatccgggcccatgacaacccggtgtgcacgctggtctcctcacacaacgtgctcttcagcggctccctgaaggccatcaaggtctgggacatcgtgggcactgagctgaagttgaagaaggagctcacaggcctcaaccactgggtgcgggccctggtggctgcccagagctacctgtacagcggctcctaccagacaatcaagatctgggacatccgaacccttgactgcatccacgtcctgcagacgtctggtggcagcgtctactccattgctgtgacaaatcaccacattgtctgtggcacctacgagaacctcatccacgtgtgggacattgagtccaaggagcaggtgcggaccctcacgggccacgtgggcaccgtgtatgccctggcggtcatctcgacgccagaccagaccaaagtcttcagtgcatcctacgaccggtccctcagggtctggagtatggacaacatgatctgcacgcagaccctgctgcgtcaccagggcagtgtcaccgcgctggctgtgtcccggggccgactcttctcaggggctgtggatagcactgtgaaggtttggacttgctaacaggatccaggccaggctgtggtttcccctgaaccagccctggacctttctgagccaggctggccacatggggtggtctcggggtttctgcctgccccgtgggcataggtggacaggctctggcagccgggcagtgccctccccgtcccatgctcggcgagcctccctctactcggcactgtccttgctgcccagcccctctctgggtgccaggtacgacgcttgccccggcccaccctccatccccaccctccatccccaccctagatggagcgagggcctttttactcaccttttctaccgtttttagactgtatgtagatttggttacctcctggttgaaataaatgctccacagactgtggctgtgagtggggacagctcctcgggacaagggggctgtgtgtggccttgaggttggtgtgcacaggcactggctgctgtgagtgggggggcatggggcagtttcctttggtggaccccaggacttcggcccactccggggcctcccctccctgctaggaggcaactcgtcacacccaagctgctggcctccagtcccatctcccccaacacatgtgcccccaaaaagtgagccaggcacctctgtttcctgctgtttattgacagccgacggcagcgccttgcccagacctcccctgcccacctgctggagcccagcctgtgccgccctctgaggagaggcctggggggacagctgggcacgtccactcgcagggaaacacggggtgagacagcaggaaggggccctgcacgccgggacgccacctccgccagccgcctccacccgccccacaccacaatcgctggttttcggcattttttaaattttttttttaagaaacgtcaaagttgtgcccaacactgtggatcagcaaacacgatagaggagaccagtcagtacttcttggagggggcaggaggagagaggaaaagggagggcgagaatgaccacacaacacagccttggaccatgagcagaagcgtccgtgggaactccactggggtggatgggctgcctgcacagcccctggagagggggccaggcacaccctcagaggagctgcaagcccgtggcctggcctgctacatgccctgcttccacgtggctgccacgctgacacacccacattcaccaaacccacccgcgccctgggacgcagccacgccaggaggaggacacggccgccgagagcaaggcacaacctcgagttcttggggcgcagagaacttaggagagaagcacggaggagcccccggcagagcacccgcccccgggccccagccttccacctgtgctagcagcctggggcctccactctggccggaggaaggaccgcaggcagacagcctgggcctctaacagcttttgtccggagctagacttcgtgtcctttcagttggtaaatggttttctatagaatcaataatatttctttctttaaatatatatttgttaaagtta

SEQ ID NO: 357330 - DNA, 4090 bp, Homo sapiens
gaggcagccgtccgggcccggagaggcggggaactacacgtcccggcgggcgcagcggcctggcgcttccggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgacctgctcttcagtggctcctctgacaagaccatcaaggtgtgggacacatgtaccacctacaagtgtcagaagacactggagggccatgatggcatcgtgctggctctctgcatccaggggtgcaaactctacagcggctctgcagactgcaccatcattgtgtgggacatccagaacctgcagaaggtgaacaccatccgggcccatgacaacccggtgtgcacgctggtctcctcacacaacgtgctcttcagcggctccctgaaggccatcaaggtctgggacatcgtgggcactgagctgaagttgaagaaggagctcacaggcctcaaccactgggtgcgggccctggtggctgcccagagctacctgtacagcggctcctaccagacaatcaagatctgggacatccgaacccttgactgcatccacgtcctgcagacgtctggtggcagcgtctactccattgctgtgacaaatcaccacattgtctgtggcacctacgagaacctcatccacgtgtgggacattgagtccaaggagcaggtgcggaccctcacgggccacgtgggcaccgtgtatgccctggcggtcatctcgacgccagaccagaccaaagtcttcagtgcatcctacgaccggtccctcagggtctggagtatggacaacatgatctgcacgcagaccctgctgcgtcaccagggcagtgtcaccgcgctggctgtgtcccggggccgactcttctcaggggctgtggatagcactgtgaaggtttggacttgctaacaggatccaggccaggctgtggtttcccctgaaccagccctggacctttctgagccaggctggccacatggggtggtctcggggtttctgcctgccccgtgggcataggtggacaggctctggcagccgggcagtgccctccccgtcccatgctcggcgagcctccctctactcggcactgtccttgctgcccagcccctctctgggtgccaggtacgacgcttgccccggcccaccctccatccccaccctccatccccaccctagatggagcgagggcctttttactcaccttttctaccgtttttagactgtatgtagatttggttacctcctggttgaaataaatgctccacagactgtggctgtgagtggggacagctcctcgggacaagggggctgtgtgtggccttgaggttggtgtgcacaggcactggctgctgtgagtgggggggcatggggcagtttcctttggtggaccccaggacttcggcccactccggggcctcccctccctgctaggaggcaactcgtcacacccaagctgctggcctccagtcccatctcccccaacacatgtgcccccaaaaagtgagccaggcacctctgtttcctgctgtttattgacagccgacggcagcgccttgcccagacctcccctgcccacctgctggagcccagcctgtgccgccctctgaggagaggcctggggggacagctgggcacgtccactcgcagggaaacacggggtgagacagcaggaaggggccctgcacgccgggacgccacctccgccagccgcctccacccgccccacaccacaatcgctggttttcggcattttttaaattttttttttaagaaacgtcaaagttgtgcccaacactgtggatcagcaaacacgatagaggagaccagtcagtacttcttggagggggcaggaggagagaggaaaagggagggcgagaatgaccacacaacacagccttggaccatgagcagaagcgtccgtgggaactccactggggtggatgggctgcctgcacagcccctggagagggggccaggcacaccctcagaggagctgcaagcccgtggcctggcctgctacatgccctgcttccacgtggctgccacgctgacacacccacattcaccaaacccacccgcgccctgggacgcagccacgccaggaggaggacacggccgccgagagcaaggcacaacctcgagttcttggggcgcagagaacttaggagagaagcacggaggagcccccggcagagcacccgcccccgggccccagccttccacctgtgctagcagcctggggcctccactctggccggaggaaggaccgcaggcagacagcctgggcctctaacagcttttgtccggagctagacttcgtgtcctttcagttggtaaatggttttctatagaatcaataatatttctttctttaaatatatatttgttaaagttatacctttttgtttctctggggaaatccgcctcagctcattcccaataaattaatactcttgatagcttatattctgggggtgcggtggggcaggggggccctgaccttggtcccctgtcccttgtgctgcgcccgagcggctggccgggcgtcccgatgggcagttctgtgctgggcccgggcctgtgcgctgccccatccctggtcccggggcgccctcccctcccgcgcgggcaggaggcccagcaggtattgcacggggagcagcaggtggggaggacccgcgggcgcagggtctgcctagagcccttggagcccccggccaggcggtccccggtgggcgccccggcccgggtccaggggccggagttgtgcttctgcagggccctg

SEQ ID NO: 357331 - DNA, 2577 bp, Homo sapiens
accaaagaacacagaaaactacggctaggtacgaggtctgggtggtgaagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgacctgctcttcagtggctcctctgacaagaccatcaaggtgtgggacacatgtaccacctacaagtgtcagaagacactggagggccatgatggcatcgtgctggctctctgcatccaggggtgcaaactctacagcggctctgcagactgcaccatcattgtgtgggacatccagaacctgcagaaggtgaacaccatccgggcccatgacaacccggtgtgcacgctggtctcctcacacaacgtgctcttcagcggctccctgaaggccatcaaggtctgggacatcgtgggcactgagctgaagttgaagaaggagctcacaggcctcaaccactgggtgcgggccctggtggctgcccagagctacctgtacagcggctcctaccagacaatcaagatctgggacatccgaacccttgactgcatccacgtcctgcagacgtctggtggcagcgtctactccattgctgtgacaaatcaccacattgtctgtggcacctacgagaacctcatccacgtgtgggacattgagtccaaggagcaggtgcggaccctcacgggccacgtgggcaccgtgtatgccctggcggtcatctcgacgccagaccagaccaaagtcttcagtgcatcctacgaccggtccctcagggtctggagtatggacaacatgatctgcacgcagaccctgctgcgtcaccagggcagtgtcaccgcgctggctgtgtcccggggccgactcttctcaggggctgtggatagcactgtgaaggtttggacttgctaacaggatccaggccaggctgtggtttcccctgaaccagccctggacctttctgagccaggctggccacatggggtggtctcggggtttctgcctgccccgtgggcataggtggacaggctctggcagccgggcagtgccctccccgtcccatgctcggcgagcctccctctactcggcactgtccttgctgcccagcccctctctgggtgccaggtacgacgcttgccccggcccaccctccatccccaccctccatccccaccctagatggagcgagggcctttttactcaccttttctaccgtttttagactgtatgtagatttggttacctcctggttgaaataaatgctccacagactgtggctgtgagtggggacagctcctcgggacaagggggctgtgtgtggccttgaggttggtgtgcacaggcactggctgctgtgagtgggggggcatggggcagtttcctttggtggaccccaggacttcggcccactccggggcctcccctccctgctaggaggcaactcgtcacacccaagctgctggcctccagtcccatctcccccaacacatgtgcccccaaaaagtgagccaggcacctctgtttcctgctgtttattgacagccgacggcagcgccttgcccagacctcccctgcccacctgctggagcccagcctgtgccgccctctgaggagaggcctggggggacagctgggcacgtccactcgcagggaaacacggggtgagacagcaggaaggggccctgcacgccgggacgccacctccgccagccgcctccacccgccccacaccacaatcgctggttttcggcattttttaaattttttttttaagaaacgtcaaagttgtgcccaacactgtggatcagcaaacacgatagaggagaccagtcagtacttcttggagggggcaggaggagagaggaaaagggagggcgagaatgaccacacaacacagccttggaccatgagcagaagcgtccgtgggaactccactggggtggatgggctgcctgcacagcccctggagagggggccaggcacaccctcagaggagctgcaagcccgtggcctggcctgctacatgccctgcttccacgtggctgccacgctgacacacccacattcaccaaacccacccgcgccctgggacgcagccacgccaggaggaggacacggccgccgagagcaaggcacaacctcgagttcttggggcgcagagaacttaggagagaagcacggaggagcccccggcagagcacccgcccccgggccccagccttccacctgtgctagcagcctggggcctccactctggccggaggaaggaccgcaggcagacagcctgggcctctaacagcttttgtccggagctagacttcgtgtcctttcagttggtaaatggttttctatagaatcaataatatttctttctttaaatatatatttgttaaagtta

SEQ ID NO: 357332 - DNA, 2026 bp, Homo sapiens
gaggcagccgtccgggcccggagaggcggggaactacacgtcccggcgggcgcagcggcctggcgcttccggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgacctgctcttcagtggctcctctgacaagaccatcaaggtgtgggacacatgtaccacctacaagtgtcagaagacactggagggccatgatggcatcgtgctggctctctgcatccaggggtgcaaactctacagcggctctgcagactgcaccatcattgtgtgggacatccagaacctgcagaaggtgaacaccatccgggcccatgacaacccggtgtgcacgctggtctcctcacacaacgtgctcttcagcggctccctgaaggccatcaaggtctgggacatcgtgggcactgagctgaagttgaagaaggagctcacaggcctcaaccactgggtgcgggccctggtggctgcccagagctacctgtacagcggctcctaccagacaatcaagatctggaacatccgacttgatgtcacgtcgaaagttgtgggcgctcatcatgtgtgcaaccccttgtgggctagaacctccggtgagggacaggacgggacccggcaggacggttcggggacagaaacaatgagtaacgccggtgggataacgacaagaacgggggccaggaagaaacgcacaggggggggacacacaa

SEQ ID NO: 357333 - DNA, 1892 bp, Homo sapiens
gaggcagccgtccgggcccggagaggcggggaactacacgtcccggcgggcgcagcggcctggcgcttccggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgactgcaagcccgtggcctggcctgctacatgccctgcttccacgtggctgccacgctgacacacccacattcaccaaacccacccgcgccctgggacgcagccacgccaggaggaggacacggccgccgagagcaaggcacaacctcgagttcttggggcgcagagaacttaggagagaagcacggaggagcccccggcagagcacccgcccccgggccccagccttccacctgtgctagcagcctggggcctccactctggccggaggaaggaccgcaggcagacagcctgggcctctaacagcttttgtccggagctagacttcgtgtcctttcagttggtaaatggttttctatagaatcaataatatttctttctttaaatatatatttgttaaagttatacctttttgtttctctggggaaatccgcctcagctcattcccaataaattaatactcttgat

SEQ ID NO: 357334 - DNA, 733 bp, Homo sapiens
gaggcagccgtccgggcccggagaggcggggaactacacgtcccggcgggcgcagcggcctggcgcttccggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagaagaacttaggagagaagcacggaggagcccccggcagagcacccgcccccgggccccagccttccacctgtgctagcagcctggggcctccactctggccggaggaaggaccgcaggcagacagcctgggcctctaacagcttttgtccggagctagacttcgtgtcctttcagttggtaaatggttttctatagaatcaataatatttctttctttaaatatatatttgttaaagtta

SEQ ID NO: 357335 - DNA, 444 bp, Homo sapiens
gaggcagccgtccgggcccggagaggcggggaactacacgtcccggcgggcgcagcggcctggcgcttccggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacaggggtaagggtgtgcccctctgcaagcccaacatccccaggacccccagcatgccccagggatctggtgttgcctgcagagctcccagcgcagtcccgtcccgagctggggtctcaggggagctcggtgggggggggtgtggtgtgtgtgtgtgtgtgtgtgcgc

SEQ ID NO: 357336 - DNA, 260 bp, Homo sapiens
gtcgcatggttaagtgtgtgagtgctgcgtggcctggcctggtcgcgtgttaggcatgtgagtgggctccacatgtgcacgtcctccttgtgtcccggaatgaggccaggtctcctccgtcctccctctagaccagaatggaaacgaccttcggacccgccttttcagccgtcaccaccatcacaaaaggtgagcccttaagccaaggccagcccaggctgggaataaccggggcacccccatgcccaccctgctaagga

SEQ ID NO: 357337 - DNA, 3711 bp, Homo sapiens
gaggcagccgtccgggcccggagaggcggggaactacacgtcccggcgggcgcagcggcctggcgcttccggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgacctgctcttcagtggctcctctgacaagaccatcaaggtgtgggacacatgtaccacctacaagtgtcagaagacactggagggccatgatggcatcgtgctggctctctgcatccaggggtgcaaactctacagcggctctgcagactgcaccatcattgtgtgggacatccagaacctgcagaaggtgaacaccatccgggcccatgacaacccggtgtgcacgctggtctcctcacacaacgtgctcttcagcggctccctgaaggccatcaaggtctgggacatcgtgggcactgagctgaagttgaagaaggagctcacaggcctcaaccactgggtgcgggccctggtggctgcccagagctacctgtacagcggctcctaccagacaatcaagatctgggacatccgaacccttgactgcatccacgtcctgcagacgtctggtggcagcgtctactccattgctgtgacaaatcaccacattgtctgtggcacctacgagaacctcatccacgtgtgggacattgagtccaaggagcaggtgcggaccctcacgggccacgtgggcaccgtgtatgccctggcggtcatctcgacgccagaccagaccaaagtcttcagtgcatcctacgaccggtccctcagggtctggagtatggacaacatgatctgcacgcagaccctgctgcgtcaccagggcagtgtcaccgcgctggctgtgtcccggggccgactcttctcaggggctgtggatagcactgtgaaggtttggacttgctaacaggatccaggccaggctgtggtttcccctgaaccagccctggacctttctgagccaggctggccacatggggtggtctcggggtttctgcctgccccgtgggcataggtggacaggctctggcagccgggcagtgccctccccgtcccatgctcggcgagcctccctctactcggcactgtccttgctgcccagcccctctctgggtgccaggtacgacgcttgccccggcccaccctccatccccaccctccatccccaccctagatggagcgagggcctttttactcaccttttctaccgtttttagactgtatgtagatttggttacctcctggttgaaataaatgctccacagactgtggctgtgagtggggacagctcctcgggacaagggggctgtgtgtggccttgaggttggtgtgcacaggcactggctgctgtgagtgggggggcatggggcagtttcctttggtggaccccaggacttcggcccactccggggcctcccctccctgctaggaggcaactcgtcacacccaagctgctggcctccagtcccatctcccccaacacatgtgcccccaaaaagtgagccaggcacctctgtttcctgctgtttattgacagccgacggcagcgccttgcccagacctcccctgcccacctgctggagcccagcctgtgccgccctctgaggagaggcctggggggacagctgggcacgtccactcgcagggaaacacggggtgagacagcaggaaggggccctgcacgccgggacgccacctccgccagccgcctccacccgccccacaccacaatcgctggttttcggcattttttaaattttttttttaagaaacgtcaaagttgtgcccaacactgtggatcagcaaacacgatagaggagaccagtcagtacttcttggagggggcaggaggagagaggaaaagggagggcgagaatgaccacacaacacagccttggaccatgagcagaagcgtccgtgggaactccactggggtggatgggctgcctgcacagcccctggagagggggccaggcacaccctcagaggagctgcaagcccgtggcctggcctgctacatgccctgcttccacgtggctgccacgctgacacacccacattcaccaaacccacccgcgccctgggacgcagccacgccaggaggaggacacggccgccgagagcaaggcacaacctcgagttcttggggcgcagagaacttaggagagaagcacggaggagcccccggcagagcacccgcccccgggccccagccttccacctgtgctagcagcctggggcctccactctggccggaggaaggaccgcaggcagacagcctgggcctctaacagcttttgtccggagctagacttcgtgtcctttcagttggtaaatggttttctatagaatcaataatatttctttctttaaatatatatttgttaaagttatacctttttgtttctctggggaaatccgcctcagctcattcccaataaattaatactcttgat

SEQ ID NO: 357338 - DNA, 796 bp, Homo sapiens
gaggcagccgtccgggcccggagaggcggggaactacacgtcccggcgggcgcagcggcctggcgcttccggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacaggggtctcctccgtcctccctctagaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatggtaggtccctacccccaggagcccgtgtgagcctcagcctccccccatcctccctcctgggggaaccaggtcccaggaggagttgacagtgagctggtgaggcacaggagaagaagagcacctgtggataccctgaggcctcggcagacatggcaagtctgtgagaaaggaggctcctgtggctggactgtgggtggcagggggcagccagtgagggcagctgggtcagagggcctggcccctgcaggccaggatgaggcatatttggctccatcttaagggaggtggaaaccacagaaagttcagtcaggaggatagcacaataaaatacatgctttgaaa

SEQ ID NO: 357339 - DNA, 3872 bp, Homo sapiens
catggttaagcgtgttagtgctgcgtggcctggcctggtcgcatggttaagcgtgtgagtgctgtgtggcgcagcctggtcgcatggttaaacgtgtgagtgctgcgtggcctggcctggtcgcatggtttagcgtgttagtgctgcgtggcctggcctggtcgcatggttaagcgtgtgagtgctgtgtggcgcagcctggtcgcatggttaagcgtgtgagtgctgcgtggcctggcctggtcgcatggttaagcgtgttagcgctgcgtgcgcggcctggtcgcatgattaagcgtgtgagtgctgcgtggcgtggcctggtcgcatggttaagtgtgtgagtgctgcgtggcctggcctggtcgcgtgttaggcatgtgagtgggctccacatgtgcacgtcctccttgtgtcccggaatgaggccaggtctcctccgtcctccctctagaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgacctgctcttcagtggctcctctgacaagaccatcaaggtgtgggacacatgtaccacctacaagtgtcagaagacactggagggccatgatggcatcgtgctggctctctgcatccaggggtgcaaactctacagcggctctgcagactgcaccatcattgtgtgggacatccagaacctgcagaaggtgaacaccatccgggcccatgacaacccggtgtgcacgctggtctcctcacacaacgtgctcttcagcggctccctgaaggccatcaaggtctgggacatcgtgggcactgagctgaagttgaagaaggagctcacaggcctcaaccactgggtgcgggccctggtggctgcccagagctacctgtacagcggctcctaccagacaatcaagatctgggacatccgaacccttgactgcatccacgtcctgcagacgtctggtggcagcgtctactccattgctgtgacaaatcaccacattgtctgtggcacctacgagaacctcatccacgtgtgggacattgagtccaaggagcaggtgcggaccctcacgggccacgtgggcaccgtgtatgccctggcggtcatctcgacgccagaccagaccaaagtcttcagtgcatcctacgaccggtccctcagggtctggagtatggacaacatgatctgcacgcagaccctgctgcgtcaccagggcagtgtcaccgcgctggctgtgtcccggggccgactcttctcaggggctgtggatagcactgtgaaggtttggacttgctaacaggatccaggccaggctgtggtttcccctgaaccagccctggacctttctgagccaggctggccacatggggtggtctcggggtttctgcctgccccgtgggcataggtggacaggctctggcagccgggcagtgccctccccgtcccatgctcggcgagcctccctctactcggcactgtccttgctgcccagcccctctctgggtgccaggtacgacgcttgccccggcccaccctccatccccaccctccatccccaccctagatggagcgagggcctttttactcaccttttctaccgtttttagactgtatgtagatttggttacctcctggttgaaataaatgctccacagactgtggctgtgagtggggacagctcctcgggacaagggggctgtgtgtggccttgaggttggtgtgcacaggcactggctgctgtgagtgggggggcatggggcagtttcctttggtggaccccaggacttcggcccactccggggcctcccctccctgctaggaggcaactcgtcacacccaagctgctggcctccagtcccatctcccccaacacatgtgcccccaaaaagtgagccaggcacctctgtttcctgctgtttattgacagccgacggcagcgccttgcccagacctcccctgcccacctgctggagcccagcctgtgccgccctctgaggagaggcctggggggacagctgggcacgtccactcgcagggaaacacggggtgagacagcaggaaggggccctgcacgccgggacgccacctccgccagccgcctccacccgccccacaccacaatcgctggttttcggcattttttaaattttttttttaagaaacgtcaaagttgtgcccaacactgtggatcagcaaacacgatagaggagaccagtcagtacttcttggagggggcaggaggagagaggaaaagggagggcgagaatgaccacacaacacagccttggaccatgagcagaagcgtccgtgggaactccactggggtggatgggctgcctgcacagcccctggagagggggccaggcacaccctcagaggagctgcaagcccgtggcctggcctgctacatgccctgcttccacgtggctgccacgctgacacacccacattcaccaaacccacccgcgccctgggacgcagccacgccaggaggaggacacggccgccgagagcaaggcacaacctcgagttcttggggcgcagagaacttaggagagaagcacggaggagcccccggcagagcacccgcccccgggccccagccttccacctgtgctagcagcctggggcctccactctggccggaggaaggaccgcaggcagacagcctgggcctctaacagcttttgtccggagctagacttcgtgtcctttcagttggtaaatggttttctatagaatcaataatatttctttctttaaatatatatttgttaaagtta

SEQ ID NO: 357340 - DNA, 3852 bp, Homo sapiens
gaggcagccgtccgggcccggagaggcggggaactacacgtcccggcgggcgcagcggcctggcgcttccggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatggtaggtccctacccccaggagcccgtgtgagcctcagcctccccccatcctccctcctgggggaaccaggtcccaggaggagttgacagtgagctggtgaggcacaggagaagaagagcacctgtggataccctgaggcctcggcagacatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgacctgctcttcagtggctcctctgacaagaccatcaaggtgtgggacacatgtaccacctacaagtgtcagaagacactggagggccatgatggcatcgtgctggctctctgcatccaggggtgcaaactctacagcggctctgcagactgcaccatcattgtgtgggacatccagaacctgcagaaggtgaacaccatccgggcccatgacaacccggtgtgcacgctggtctcctcacacaacgtgctcttcagcggctccctgaaggccatcaaggtctgggacatcgtgggcactgagctgaagttgaagaaggagctcacaggcctcaaccactgggtgcgggccctggtggctgcccagagctacctgtacagcggctcctaccagacaatcaagatctgggacatccgaacccttgactgcatccacgtcctgcagacgtctggtggcagcgtctactccattgctgtgacaaatcaccacattgtctgtggcacctacgagaacctcatccacgtgtgggacattgagtccaaggagcaggtgcggaccctcacgggccacgtgggcaccgtgtatgccctggcggtcatctcgacgccagaccagaccaaagtcttcagtgcatcctacgaccggtccctcagggtctggagtatggacaacatgatctgcacgcagaccctgctgcgtcaccagggcagtgtcaccgcgctggctgtgtcccggggccgactcttctcaggggctgtggatagcactgtgaaggtttggacttgctaacaggatccaggccaggctgtggtttcccctgaaccagccctggacctttctgagccaggctggccacatggggtggtctcggggtttctgcctgccccgtgggcataggtggacaggctctggcagccgggcagtgccctccccgtcccatgctcggcgagcctccctctactcggcactgtccttgctgcccagcccctctctgggtgccaggtacgacgcttgccccggcccaccctccatccccaccctccatccccaccctagatggagcgagggcctttttactcaccttttctaccgtttttagactgtatgtagatttggttacctcctggttgaaataaatgctccacagactgtggctgtgagtggggacagctcctcgggacaagggggctgtgtgtggccttgaggttggtgtgcacaggcactggctgctgtgagtgggggggcatggggcagtttcctttggtggaccccaggacttcggcccactccggggcctcccctccctgctaggaggcaactcgtcacacccaagctgctggcctccagtcccatctcccccaacacatgtgcccccaaaaagtgagccaggcacctctgtttcctgctgtttattgacagccgacggcagcgccttgcccagacctcccctgcccacctgctggagcccagcctgtgccgccctctgaggagaggcctggggggacagctgggcacgtccactcgcagggaaacacggggtgagacagcaggaaggggccctgcacgccgggacgccacctccgccagccgcctccacccgccccacaccacaatcgctggttttcggcattttttaaattttttttttaagaaacgtcaaagttgtgcccaacactgtggatcagcaaacacgatagaggagaccagtcagtacttcttggagggggcaggaggagagaggaaaagggagggcgagaatgaccacacaacacagccttggaccatgagcagaagcgtccgtgggaactccactggggtggatgggctgcctgcacagcccctggagagggggccaggcacaccctcagaggagctgcaagcccgtggcctggcctgctacatgccctgcttccacgtggctgccacgctgacacacccacattcaccaaacccacccgcgccctgggacgcagccacgccaggaggaggacacggccgccgagagcaaggcacaacctcgagttcttggggcgcagagaacttaggagagaagcacggaggagcccccggcagagcacccgcccccgggccccagccttccacctgtgctagcagcctggggcctccactctggccggaggaaggaccgcaggcagacagcctgggcctctaacagcttttgtccggagctagacttcgtgtcctttcagttggtaaatggttttctatagaatcaataatatttctttctttaaatatatatttgttaaagtta

SEQ ID NO: 357341 - DNA, 2578 bp, Homo sapiens
gaggcagccgtccgggcccggagaggcggggaactacacgtcccggcgggcgcagcggcctggcgcttccggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgacctgctcttcagtggctcctctgacaagaccatcaaggtgtgggacacatgtaccacctacaagtgtcagaagacactggagggccatgatggcatcgtgctggctctctgcatccaggggtgcaaactctacagcggctctgcagactgcaccatcattgtgtgggacatccagaacctgcagaaggtgaacaccatccgggcccatgacaacccggtgtgcacgctggtctcctcacacaacgtgctcttcagcggctccctgaaggccatcaaggtctgggacatcgtgggcactgagctgaagttgaagaaggagctcacaggcctcaaccactgggtgcgggccctggtggctgcccagagctacctgtacagcggctcctaccagacaatcaagatctgggacatccgaacccttgactgcatccacgtcctgcagacgtctggtggcagcgtctactccattgctgtgacaaatcaccacattgtctgtggcacctacgagaacctcatccacgtgtgggacattgagtccaaggagcaggtgcggaccctcacgggccacgtgggcaccgtgtatgccctggcggtcatctcgacgccagaccagaccaaagtcttcagtgcatcctacgaccggtccctcagggtctggagtatggacaacatgatctgcacgcagaccctgctgcgtcaccagggcagtgtcaccgcgctggctgtgtcccggggccgactcttctcaggggctgtggatagcactgtgaaggtttggacttgctaacaggatccaggccaggctgtggtttcccctgaaccagccctggacctttctgagccaggctggccacatggggtggtctcggggtttctgcctgccccgtgggcataggtggacaggctctggcagccgggcagtgccctccccgtcccatgctcggcgagcctccctctactcggcactgtccttgctgcccagcccctctctgggtgccaggtacgacgcttgccccggcccaccctccatccccaccctccatccccaccctagatggagcgagggcctttttactcaccttttctaccgtttttagactgtatgtagatttggttacctcctggttgaaataaatgctccacagactgtg

SEQ ID NO: 357342 - DNA, 1829 bp, Homo sapiens
gaggcagccgtccgggcccggagaggcggggaactacacgtcccggcgggcgcagcggcctggcgcttccggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgactgcaagcccgtggcctggcctgctacatgccctgcttccacgtggctgccacgctgacacacccacattcaccaaacccacccgcgccctgggacgcagccacgccaggaggaggacacggccgccgagagcaaggcacaacctcgagttcttggggcgcagagaacttaggagagaagcacggaggagcccccggcagagcacccgcccccgggccccagccttccacctgtgctagcagcctggggcctccactctggccggaggaaggaccgcaggcagacagcctgggcctctaacagcttttgtccggagctagacttcgtgtcctttcagttggtaaatggttttctatagaatcaataatatttctttctttaaatatatatttgttaaagtta

SEQ ID NO: 357343 - DNA, 1573 bp, Homo sapiens
gaggcagccgtccgggcccggagaggcggggaactacacgtcccggcgggcgcagcggcctggcgcttccggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccccatcaacgccgcggcttaaacatgggcatcctaagctcctacgaccttagccgatctgcagtgccaaggacctttgtggccccccggcccgtgtggtgtttctgcgctctccccgggtgaccgctctccggccccctgtgcaggccccgggtgcccttccccccttttctagccgcggccctggctcgggccccccggggaccacaggcacgcccttgtggcccccggcaccccgcccggcgttccgttccccccgagtgggtaaaattccc

SEQ ID NO: 357344 - DNA, 774 bp, Homo sapiens
gaggcagccgtccgggcccggagaggcggggaactacacgtcccggcgggcgcagcggcctggcgcttccggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatggtaggtccctacccccaggagcccgtgtgagcctcagcctccccccatcctccctcctgggggaaccaggtcccaggaggagttgacagtgagctggtgaggcacaggagaagaagagcacctgtggataccctgaggcctcggcagacatggcaagtctgtgagaaaggaggctcctgtggctggactgtgggtggcagggggcagccagtgagggcagctgggtcagagggcctggcccctgcaggccaggatgaggcatatttggctccatcttaagggaggtggaaaccacagaaagttcagtcaggaggatagcacaataaaatacatgctttgaaa

SEQ ID NO: 357345 - DNA, 852 bp, Homo sapiens
ccagctgtaacattctgaggcttaaaaaagctcataggagacaggctgttcttcgccatattttccataccggaagtataaagccttgagctccacgctttagacttcctcatcttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccaccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcttggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaa

SEQ ID NO: 357346 - DNA, 759 bp, Homo sapiens
cccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccaccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcttggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaa

SEQ ID NO: 357347 - DNA, 334 bp, Homo sapiens
ttacaggaaaaaggctcttgctatgaaagttaatccataaaattacaaaaatgactgttttggcagtacattgagctccacagagacagcgccagggcaagtgagagccggacgggcactgggcgactctgtgcctcgctgaggaaaaataactaaacatgggcaaaggagatcctaagaagctgagaggcaaaatgtcatcatatgcattttttgtgcaaacgtcgggaggagcataagaagaagcacccagatgcttcagtcaacttctcaagagttttctaagaagtgctcagagaggtggaagaccatttctgctaaagacaaaggaaaa

SEQ ID NO: 357348 - DNA, 720 bp, Homo sapiens
  misc_feature (44)..(44): n is a, c, g, or t
ggttacagagcggagagagtgaggaggctgcgtctggctcccgntctcacagccattgtacattgagctccacagagacagcgccagggcaagtgagagccggacgggcactgggcgactctgtgcctcgctgaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccaccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcttggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaa

SEQ ID NO: 357349 - DNA, 828 bp, Homo sapiens
  misc_feature (20)..(21): n is a, c, g, or t
  misc_feature (24)..(25): n is a, c, g, or t
  misc_feature (29)..(29): n is a, c, g, or t
  misc_feature (31)..(31): n is a, c, g, or t
  misc_feature (53)..(53): n is a, c, g, or t
  misc_feature (73)..(73): n is a, c, g, or t
tctctatatcaaccgaatannttnnaagnangaagtataaagcgttgagctcnaccctttatacttcctcaangctttatacttcctctcttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccaccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcttggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaa

SEQ ID NO: 357350 - DNA, 676 bp, Homo sapiens
  misc_feature (44)..(44): n is a, c, g, or t
ggttacagagcggagagagtgaggaggctgcgtctggctcccgntctcacagccattgcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccaccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcttggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaa

SEQ ID NO: 357351 - DNA, 662 bp, Homo sapiens
  misc_feature (8)..(8): n is a, c, g, or t
  misc_feature (32)..(32): n is a, c, g, or t
taagcttnggctaggtacgaggctgggtgttnctcagaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtgagtttcagttcattactttttactttttaagtgttgaaatagt

SEQ ID NO: 357352 - DNA, 781 bp, Homo sapiens
tgctatggctacagcacgaacgagtgtagtgcaccgaaaataggtaggaactccgcaacatcgtatgacatggtagcatagccacaaactagcatgtgggtactcgacgctgtcgacagtgctagccctctagtctagacgtataacatagtatgcgcaatacctctccattaacgactactctgggcatcatcgcgttcgcgtcacagtaattctgtacagtgcagaacgctacttagagtagggctacgaacgatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatcccta

SEQ ID NO: 357353 - DNA, 2134 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctgagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagataccta

SEQ ID NO: 357354 - DNA, 4443 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357355 - DNA, 4289 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357356 - DNA, 4100 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357357 - DNA, 3667 bp, Homo sapiens
cacactaggcaggtggaggccgggggtatcggacgagggttgtgctccttctacagccaatatgaaaaggctaagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357358 - DNA, 3638 bp, Homo sapiens
aagagcaagaagcagagcccaggacaaatgagtagtgcaaaaagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357359 - DNA, 3790 bp, Homo sapiens
gtggtaagactgcttgagcctgggtggtccaggttgcagtgagttgtgattgtgccactgcactcaggcccaagcaaaaaaaaccaaaatcaaaacgcctgatctctcattcataaagagacctaatcataccttttccataggttcgacattttataggcataactaaattgcagccagattggtttctcacttgaattctgcttaagtataaagatatttttgtaagcagacaaaatctctttattttaataggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357360 - DNA, 3309 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatattggtttttttccaaggcccaaacaccttttttgggggggggaaaaaaaaccccccccccaaaaaaagagggggggggggtgg

SEQ ID NO: 357361 - DNA, 4117 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctgagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaaggtatcctttattagtggtaagaaatgtgattctttcagattttggttgaaatatgatgagtgtacaaaatcttgatttaagtgaatgaaaaattacaagatccaactctgatttcagccagagatcatctgaaaggcaatgtagttatcttaagagctgggctctggagcctgattgcttggggtttgttgaaatttatcaggtaagttgccagaataattcaactatttggaattttagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357362 - DNA, 4583 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtaaaaggaccccttctcatgagctccttggagccatcttctttcatcataagcattttgagtagaaaaatcttggaagtgttttaaagtactggcatgtcagatgaaggacagctcctttgtttggttttttttttaaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357363 - DNA, 4095 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctgagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtaaaaggaccccttctcatgagctccttggagccatcttctttcatcataagcattttgagtagaaaaatcttggaagtgttttaaagtactggcatgtcagatgaaggacagctcctttgtttggttttttttttaaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacagggtaagctttcttttctgttggcattttggtgaccactagaataaaccttcttttgacacatcttatttttaatatcagtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357364 - DNA, 4182 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctgagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtaaaaggaccccttctcatgagctccttggagccatcttctttcatcataagcattttgagtagaaaaatcttggaagtgttttaaagtactggcatgtcagatgaaggacagctcctttgtttggttttttttttaaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacagggtaagctttcttttctgttggcattttggtgaccactagaataaaccttcttttgacacatcttatttttaatatcagtgcctcattagcttactattgccatccccctacatcttggactcctcctccatattttaatgagagtattgtggtagacatgaaaagcggcttcaatctggaagaactggaaaagaacaatgcacagagcataagaggtgagaattgtgtgtcgctgctgtcttcatcagctgacaggccagtggagctcttacctgattacatgggcttgctttctttcccagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357365 - DNA, 4532 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaggcaggcaaaaggggttctaacgaagcagcatggtatagaatcacttttactttttgaaaatctctttattttcctgcaatataggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357366 - DNA, 4672 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgtaagtgtgtcctccatgagttaaaactgaagtgagttttctagcattataatacataatggaaggaactgaagataggaaatatttgaggcttgtgatccattagccttaattttgcacatcccgttatatgtacctccaaagagttaatttttcaggtacataactacttggattaaatgagcagacaagggctactaatccagcactatttttctttgtcacacaggaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357367 - DNA, 3993 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357368 - DNA, 4837 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacagggtaagctttcttttctgttggcattttggtgaccactagaataaaccttcttttgacacatcttatttttaatatcagtgcctcattagcttactattgccatccccctacatcttggactcctcctccatattttaatgagagtattgtggtagacatgaaaagcggcttcaatctggaagaactggaaaagaacaatgcacagagcataagaggtgagaattgtgtgtcgctgctgtcttcatcagctgacaggccagtggagctcttacctgattacatgggcttgctttctttcccagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgtaagtgtgtcctccatgagttaaaactgaagtgagttttctagcattataatacataatggaaggaactgaagataggaaatatttgaggcttgtgatccattagccttaattttgcacatcccgttatatgtacctccaaagagttaatttttcaggtacataactacttggattaaatgagcagacaagggctactaatccagcactatttttctttgtcacacaggaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357369 - DNA, 2900 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtacaagccagtcatttgattggaccatcgcagtcagtctaaaactatgcatgcagatattaatctcgtg

SEQ ID NO: 357370 - DNA, 2700 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagataccta

SEQ ID NO: 357371 - DNA, 2628 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatcccta

SEQ ID NO: 357372 - DNA, 2789 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaggcaggcaaaaggggttctaacgaagcagcatggtatagaatcacttttactttttgaaaatctctttattttcctgcaatataggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagataccta

SEQ ID NO: 357373 - DNA, 2717 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaggcaggcaaaaggggttctaacgaagcagcatggtatagaatcacttttactttttgaaaatctctttattttcctgcaatataggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatcccta

SEQ ID NO: 357374 - DNA, 2646 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagataccta

SEQ ID NO: 357375 - DNA, 1849 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaagggcatgcaagttggcccctttggacaaaccggtcacaatccttaaatggcccgagctttaatggtatttccccttaaattcctccttgggctttggttttgtgaaattccaccaaggtttttgggtgagtttaaacccgtgggg

SEQ ID NO: 357376 - DNA, 1714 bp, Homo sapiens
  misc_feature (1638)..(1638): n is a, c, g, or t
  misc_feature (1640)..(1640): n is a, c, g, or t
  misc_feature (1642)..(1642): n is a, c, g, or t
  misc_feature (1651)..(1651): n is a, c, g, or t
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggttccaaatgtggggaaagcngntntcatagttnacagaccgctgtttcgtggggttcccgggcgtccagggacgcaatgttcctggaagtcccccg

SEQ ID NO: 357377 - DNA, 770 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaaataaaatgacagcttgagtcgcgcgacgtgtatcctctagagtcagctatgaccgatg

SEQ ID NO: 357378 - DNA, 735 bp, Homo sapiens
agacggggttttatcgtgttagccaggatggtcttgatctcctgaactcgtgatccgcctgtctcggcctcccaaagtgctgggattacaggcgtgagccaccgtgcctggccgcaaatgtcttatttctaattgctatcagatctggtaccaaaggagaatttggagagctggctaaattatttgaagaaagaattgccaacagtggtgttcagagcctcaacaaaaccaaaggataaagggaagataaccaaggtatcctttattagtggtaagaaatgtgattctttcagattttggttgaaatatgatgagtgtacaaaatcttgatttaagtgaatgaaaaattacaagatccaactctgatttcagccagagatcatctgaaaggcaatgtagttatcttaagagctgggctctggagcctgattgcttggggtttgttgaaatttatcaggtaagttgccagaataattcaactatttggaattttagcgtgtgaaggcaaagaagaatgctgctccattcagaagtgaagtctgctttgggaaagagggcctttggaaacttcttggaggttttcaggaaacttgcagcaaagccattcgggttggagtaattggtgagtttcagttcattactttttactttttaagtgttgaaatagttaagaagtttagccagctctccaagtgcccaagcagcagtgtatggagttgttgtcaagtaaaaggc

SEQ ID NO: 357379 - DNA, 938 bp, Homo sapiens
  misc_feature (862)..(862): n is a, c, g, or t
  misc_feature (864)..(864): n is a, c, g, or t
  misc_feature (866)..(866): n is a, c, g, or t
  misc_feature (875)..(875): n is a, c, g, or t
cacactaggcaggtggaggccgggggtatcggacgagggttgtgctccttctacagccaatatgaaaaggctaagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggttccaaatgtggggaaagcngntntcatagttnacagaccgctgtttcgtggggttcccgggcgtccagggacgcaatgttcctggaagtcccccg

SEQ ID NO: 357380 - DNA, 525 bp, Homo sapiens
ctagaggatcttcaactacagcaggtgaacagtctacaaggtcttttatcttggaagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatcccta

SEQ ID NO: 357381 - DNA, 2037 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctaagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagataccta

SEQ ID NO: 357382 - DNA, 3442 bp, Homo sapiens
  misc_feature (8)..(8): n is a, c, g, or t
  misc_feature (32)..(32): n is a, c, g, or t
taagcttnggctaggtacgaggctgggtgttnctcagaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357383 - DNA, 3172 bp, Homo sapiens
  misc_feature (8)..(8): n is a, c, g, or t
  misc_feature (32)..(32): n is a, c, g, or t
taagcttnggctaggtacgaggctgggtgttnctcagaacagagggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357384 - DNA, 4521 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacagggtaagctttcttttctgttggcattttggtgaccactagaataaaccttcttttgacacatcttatttttaatatcagtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357385 - DNA, 4608 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacagggtaagctttcttttctgttggcattttggtgaccactagaataaaccttcttttgacacatcttatttttaatatcagtgcctcattagcttactattgccatccccctacatcttggactcctcctccatattttaatgagagtattgtggtagacatgaaaagcggcttcaatctggaagaactggaaaagaacaatgcacagagcataagaggtgagaattgtgtgtcgctgctgtcttcatcagctgacaggccagtggagctcttacctgattacatgggcttgctttctttcccagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357386 - DNA, 2779 bp, Homo sapiens
ctgtcttagaggaccccttcgacggtgtctgtgtggtctcccaacactaagttaagatgcaagttttgtattgcaagttatgtttatttttcattcacaattatactgagaatgttatattaggaaaaattgtatctacatgggcatctgctattagacttcctgcattgtacaggaactaagctatagtttctatcatctgtaactccttcgacggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357387 - DNA, 4761 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgtaagtgtgtcctccatgagttaaaactgaagtgagttttctagcattataatacataatggaaggaactgaagataggaaatatttgaggcttgtgatccattagccttaattttgcacatcccgttatatgtacctccaaagagttaatttttcaggtacataactacttggattaaatgagcagacaagggctactaatccagcactatttttctttgtcacacaggaaaacagctcaggcatgtttgctgcagaagagacaggggaggcactgtctgaggagactacagcaggtgaggcaggcaaaaggggttctaacgaagcagcatggtatagaatcacttttactttttgaaaatctctttattttcctgcaatataggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357388 - DNA, 3041 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatccttcgtcgtctctcgcagccgtagtcgcgcggccgcg

SEQ ID NO: 357389 - DNA, 2340 bp, Homo sapiens
ctagaggatcttcaactacagcaggtgaacagtctacaaggtcttttatcttggaagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357390 - DNA, 2734 bp, Homo sapiens
  misc_feature (2701)..(2701): n is a, c, g, or t
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctantcgacgcgcgtcgacgtcgacgcggccgcgaat

SEQ ID NO: 357391 - DNA, 2098 bp, Homo sapiens
ggcttactttttattcttcgctttctcttgtgagccccccctgtcatagtggtccccccttgttggtcctcctccgctcgttccccttttgcgggttgtgttgtccgagccaccgctctcgtttttactccccccgtgctctcttttttagatttggtgtgagaaatctcctccgctccgttcttttcatgtccccacgtggttttctctttgtggtttccgctcttggtgccgcccgtttgacggctatctcctttgttggtccccccggtcccccatcgaattgttctatagcgaacccttttccaggccccatccccccccacaagtttttttttgtttttgtcgtttttttttgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactgactaactcctgttagtcaagactctaggaattgaaatacaacagtttttcacagctaggccagttacatacttactctacattgagtttcatccatttttccagttggttagttatattctgtcgtttccattccgtcaggtttgcaacaaaaactccaggattaaatgagcaagtgctggctttcatggaaagcttacgaattctttcctttttatagtcaagatagccaatgtaattgtactaaaaacacaaataggatatatgtacttactgcttcaaacaaaatagatacaattttatagccagtagagagaagagctgttaaactgacttcttcagattagaaaataaatatttgaaattccaagttagaataggaacctagatgttgacataataaaccagatgttcaagaacaattaggctgtcaagtccatgaagaagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357392 - DNA, 2844 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcagtctacagaaaagcaggcttgagttttgggatgaaatgattggggagtgtaaattgcagcaaaagagttccctgaatttgcaacctcttcccattaaacaatattgtaggaagaggggtgtttggtaagcaatttacctggtttcctgctccacggatgacaactttagtagaggctgaatcacaatcttctgaaaatgcagctgcatgtcctggcttcagtgctgtattgtaaagggcaagaatatcacctgaaatagacaagatgttaagatttacatttccgttgccttgagagttccctgttactcccacttctccctatggtgaccttttatagaagaccataaataaaccactacagcccactgtagcccattgttttatttagcaattgtacccaatctgggtggagacagcactcatggtgacatttttgatac

SEQ ID NO: 357393 - DNA, 2647 bp, Homo sapiens
  misc_feature (2491)..(2491): n is a, c, g, or t
  misc_feature (2516)..(2516): n is a, c, g, or t
  misc_feature (2534)..(2534): n is a, c, g, or t
  misc_feature (2542)..(2542): n is a, c, g, or t
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacagggtaagctttcttttctgttggcattttggtgaccactagaataaaccttcttttgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctaaaaaaaanaaaaaaaaataaaaaaaaaaaaaanaaaaaaaaaaaaaaaaanattaaaanaaatattcatctctataattctacttcctttttacactcctccctttttctcactttcatattacaattccttccctctcctctctaacattcacctcatttcca

SEQ ID NO: 357394 - DNA, 1097 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctgagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtgagtttcagttcattactttttactttttaagtgttgaaatagt

SEQ ID NO: 357395 - DNA, 2071 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgctgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcaggtgagtaaagagggtaccctttgtcttctgtgtacatgggtgaggtacgaggaaacagtctgatagtcactgaagactgattagatccaactctgatctcagcaaagccagagtacgtgcactttgccagagacagtgctaggcagtggggagccaggtgacttttacaactgactcaactggtttctactattcttttgccattcagtatttaccatcttttaaataaagagtgtaagctgctatacccagcttattgtgtagtatatttcatctaggaagtgatgacagtgtgacaaattccccacacctacacaatgtcgggtattagttcaagagtgaaataaattggaacgtatgtgacaaaatatttaaatgaaatgcataattatgcatctgagtttgagcagcaggaaaaagaaaacccagaacagagaattacaaagcagaaaatgggaatgagatctaaaattgttgttggggttaagaaacaattggctgcttgggaggctgaagtgggcacatcctggctaacaaggtgaaactccctttctactaaaaatacaaaaaattagccgggtgtggtggtggatgctggtagtcccagctacttgggaggctgaggcaggagaatggtgtgaacctgggaggtggagcttgcaatgagccgagatccaaccactgcactccagcc

SEQ ID NO: 357396 - DNA, 961 bp, Homo sapiens
ggcttttagacattatatatattatcagagaagtagcctagtggtcgtggggcacagaaaaaatagataggggcagctctaaagaccagctgttaagacagacaactgcaaactcatttaagcaagagaaaaacagctctaattcgagattgtgaagcaacacttctaaattcaaagacatagagttgtcaaatcaggattttttttttttaaaatgatatcctttcgaatgtaactgattttgggaaaatcacatgttcagaattgaggctaaatggtttgatcaggttttctctttgaagagaccacagccttaggaaatggttcttgatctatacaattccaccttggacactgggttaattctgtttgcccctggaacacaatcactgcctggctcaaaagctactgcaagctcgttactgctcatcctccagaggcccacatcaagtcagccacgactcaaggagactccaaagataaaagctgaagccaaaatatatgattctaaacaccctcctcggctactgcaaagcactgtgagcactttctcaggacgagagccaagaagcccagcacctatgggtcaccacagtttccgaggtcccagatgaaaaagatgcgctcgctaccaccgtgcggcggtcctttctctcgcaatagtctcaatgctcccgggccctgcctccggacgccaggacagaggccgccgactcgaagcgtgagcagttccggaggtacttggagaagtcgggggtgctggacacgctgaccaaggtgttggtagccttcattttgaagaaccagagaaacctaacaggtgcttgggcgttttaaaagcttcacttagggagctggtactccagaaaatccagaataaagcggttccactaaaactgccaatgcacgacaatttaagcttggtgaaaaaaccaactgacaccaagtgtcagttgacact

SEQ ID NO: 357397 - DNA, 530 bp, Homo sapiens
agcaaatgtttctttgggaagatatagtttattgcatatcaagtatttgaacagtgcagtcatgaactggaatgaaattttagtttcaaagcaattttaaaggtttatatgaaaagggctttcattagatttgattgtattaaatcttaaatcactgaatgatttaaaatggatagttatagaaactgatattaatacaatttactgacagtaactaagttgaatataacagttaccttgttttactattttttactcaatttagaataaaattcacctaaattcctctgtctttgccccatagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggt

SEQ ID NO: 357398 - DNA, 507 bp, Homo sapiens
agcaaatgtttctttgggaagatatagtttattgcatatcaagtatttgaacagtgcagtcatgaactggaatgaaattttagtttcaaagcaattttaaaggtttatatgaaaagggctttcattagatttgattgtattaaatcttaaatcactgaatgatttaaaatggatagttatagaaactgatattaatacaatttactgacagtaactaagttgaatataacagttaccttgttttactattttttactcaatttagaataaaattcacctaaattcctctgtctttgccccatagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaaacttctaaaactagggctattgaaacttctaaaactaggcctagttttagaagtttctatagca

SEQ ID NO: 357399 - DNA, 3258 bp, Homo sapiens
ggcttttagacattatatatattatcagagaagtagcctagtggtcgtggggcacagaaaaaatagataggggcagctctaaagaccagctgttaagacagacaactgcaaactcatttaagcaagagaaaaacagctctaattcgagattgtgaagcaacacttctaaattcaaagacatagagttgtcaaatcaggattttttttttttaaaatgatatcctttcgaatgtaactgattttgggaaaatcacatgttcagaattgaggctaaatggtttgatcaggttttctctttgaagagaccacagccttaggaaatggttcttgatctatacaattccaccttggacactgggttaattctgtttgcccctggaacacaatcacgtaagtttccttctagactggcatcctgatgtgtcttgagtataatcacatgttgctacctagtaaataaaatcttaagaagatccgtggctttccttcaccagttcatagcatcgtgattcattgcccggattggactcgactctactcactggacatctaaccactccacttaattaacaatacccaccctacaggggtgttgtaaggattaaaatttaaaatacccgtgttttctacagtgcctggctcaaaagctactgcaagctcgttactgctcatcctccagaggcccacatcaagtcagccacgactcaaggagactccaaagataaaagctgaagccaaaatatatgattctaaacaccctcctcggctactgcaaagcactgtgagcactttctcaggacgagagccaagaagcccagcacctatgggtcaccacagtttccgaggtcccagatgaaaaagatgcgctcgctaccaccgtgcggcggtcctttctctcgcaatagtctcaatgctcccgggccctgcctccggacgccaggacagaggtaccaaaatctcacctcctgcaaagaaacctaattgctacgggggccggaagaggaagaggtgcggctccgacagccagaggggcgggcatacgcagcctccctcggctcagcctgctactggggatgcagagcgtcctggtcgccatgaaaacaggccacacctcggcgatcccggccggtggtttgcaagtgcgcaggcgcgcgcccccttccgcgcatgagcagtgctgctcccaacccgccagtcgcggtctccggcgccagctacgccgctgccgctgtcactatggcccattacaaagccgccgactcgaagcgtgagcagttccggaggtacttggagaagtcgggggtgctggacacgctgaccaaggtgttggtagccttatatgaagaaccagagaaacctaacagtgctttggattttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggtcttaaagcaggagaatccaaagtaaatcctgaacaaaacctaaacacagccatctaactcattaccttaaaagacattctgtttattagtctgattaggaatgatggcactggttgtattttagccaagacagtttagcatggagctattccttggtgcagttcaggatatgaacacaggtacagtcattctttgaaggtgacactgttctgtatattccctataggcagctggagagatctgtgtgacacaagatgcttttgtacgggttcccatgaatcttctgctcttgtttgtgtgacatggaacaaataacttctttgccaccactttgccttagataactgtgtgtgtgtgtgccagtttgaactctgacaccacattttccttctatgcaatcatgcctgtctgataatcttgcattgctttcctctgagctttagtgggtcctagttgcacactggcctttctgtgctgtttttcaatttgcctaataatagcagttaccctgattgtaatttatgtaactttaaacaggatcacactgtaccccctgcctgccttatttgcttactgagcacaggacagaggcaatatacaactctgggttcacacacaagctgagatgagaagaggaatgagccatatattggggaaaatcatagtttgtaggtataattatatagtgcttttctccctcaaagtatttttctagccttgaattcattttatcttcattatccctgtgaagtaggtgggacaagtataaggggaagaggggtgctgaatttttaggccaaagactgatattaatacaaatcactcactaactgtagagccttgggcattatcagtgaactactctgagatttactgtcttcatctgtttaatgagtagaatgtccgtgatgcctacctcacagggttgttgtgagggtcaaatgagaatgtatgtgaaagatttgtaaatggtaaagcactatattcttgtttgttagtcctttttcctttctttgggtagacctacagtcagatgttttgttttatggatcacttattttccttactggtagactgtcgttttatagacatattcctatttcatatattctctccctgttgttagagaacctatctttgtttttggtcaaaacacacatagaaaacaaaatgatccaatgaaaactggtttaactagcaaaagccttggcacctgttggagactatgaccaagccaataaaaagggcatttaaatcagccctgttagtaggaatgtggctatggctggtgcctcttctagtcacaagtttgtttttggagggggtccagaagatcattcccttgcatagatttctcttttaccaatttgagtgcctcctacatgggcagcagtggactaagtgctgggtgtgataaagaggaatgacttaattatgagactgtatataatcaaatacagtgtgggttaggacctgtggcagaccattataataaagcatggccccgtgagggttttgaaagagaaaga

SEQ ID NO: 357400 - DNA, 2066 bp, Homo sapiens
  misc_feature (13)..(14): n is a, c, g, or t
  misc_feature (21)..(22): n is a, c, g, or t
  misc_feature (25)..(25): n is a, c, g, or t
atttcggcacagnntcagccnnacngccgcttgccgctgtcactatggcccattacaaagccgccgactcgaagcgtgagcagttccggaggtacttggagaagtcgggggtgctggacacgctgaccaaggtgttggtagccttatatgaagaaccagagaaacctaacagtgctttggattttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggtcttaaagcaggagaatccaaagtaaatcctgaacaaaacctaaacacagccatctaactcattaccttaaaagacattctgtttattagtctgattaggaatgatggcactggttgtattttagccaagacagtttagcatggagctattccttggtgcagttcaggatatgaacacaggtacagtcattctttgaaggtgacactgttctgtatattccctataggcagctggagagatctgtgtgacacaagatgcttttgtacgggttcccatgaatcttctgctcttgtttgtgtgacatggaacaaataacttctttgccaccactttgccttagataactgtgtgtgtgtgtgccagtttgaactctgacaccacattttccttctatgcaatcatgcctgtctgataatcttgcattgctttcctctgagctttagtgggtcctagttgcacactggcctttctgtgctgtttttcaatttgcctaataatagcagttaccctgattgtaatttatgtaactttaaacaggatcacactgtaccccctgcctgccttatttgcttactgagcacaggacagaggcaatatacaactctgggttcacacacaagctgagatgagaagaggaatgagccatatattggggaaaatcatagtttgtaggtataattatatagtgcttttctccctcaaagtatttttctagccttgaattcattttatcttcattatccctgtgaagtaggtgggacaagtataaggggaagaggggtgctgaatttttaggccaaagactgatattaatacaaatcactcactaactgtagagccttgggcattatcagtgaactactctgagatttactgtcttcatctgtttaatgagtagaatgtccgtgatgcctacctcacagggttgttgtgagggtcaaatgagaatgtatgtgaaagatttgtaaatggtaaagcactatattcttgtttgttagtcctttttcctttctttgggtagacctacagtcagatgttttgttttatggatcacttattttccttactggtagactgtcgttttatagacatattcctatttcatatattctctccctgttgttagagaacctatctttgtttttggtcaaaacacacatagaaaacaaaatgatccaatgaaaactggtttaactagcaaaagccttggcacctgttggagactatgaccaagccaataaaaagggcatttaaatcagccctgttagtaggaatgtggctatggctggtgcctcttctagtcacaagtttgtttttggagggggtccagaagatcattcccttgcatagatttctcttttaccaatttgagtgcctcctacatgggcagcagtggactaagtgctgggtgtgataaagaggaatgacttaattatgagactgtatataatcaaatacagtgtgggttaggacctgtggcagaccattataataaagcatggccccgtgagggttttgaaagagaaaga

SEQ ID NO: 357401 - DNA, 1688 bp, Homo sapiens
ggcttttagacattatatatattatcagagaagtagcctagtggtcgtggggcacagaaaaaatagataggggcagctctaaagaccagctgttaagacagacaactgcaaactcatttaagcaagagaaaaacagctctaattcgagattgtgaagcaacacttctaaattcaaagacatagagttgtcaaatcaggattttttttttttaaaatgatatcctttcgaatgtaactgattttgggaaaatcacatgttcagaattgaggctaaatggtttgatcaggttttctctttgaagagaccacagccttaggaaatggttcttgatctatacaattccaccttggacactgggttaattctgtttgcccctggaacacaatcacgtaagtttccttctagactggcatcctgatgtgtcttgagtataatcacatgttgctacctagtaaataaaatcttaagaagatccgtggctttccttcaccagttcatagcatcgtgattcattgcccggattggactcgactctactcactggacatctaaccactccacttaattaacaatacccaccctacaggggtgttgtaaggattaaaatttaaaatacccgtgttttctacagtgcctggctcaaaagctactgcaagctcgttactgctcatcctccagaggcccacatcaagtcagccacgactcaaggagactccaaagataaaagctgaagccaaaatatatgattctaaacaccctcctcggctactgcaaagcactgtgagcactttctcaggacgagagccaagaagcccagcacctatgggtcaccacagtttccgaggtcccagatgaaaaagatgcgctcgctaccaccgtgcggcggtcctttctctcgcaatagtctcaatgctcccgggccctgcctccggacgccaggacagaggtaccaaaatctcacctcctgcaaagaaacctaattgctacgggggccggaagaggaagaggtgcggctccgacagccagaggggcgggcatacgcagcctccctcggctcagcctgctactggggatgcagagcgtcctggtcgccatgaaaacaggccacacctcggcgatcccggccggtggtttgcaagtgcgcaggcgcgcgcccccttccgcgcatgagcagtgctgctcccaacccgccagtcgcggtctccggcgccagctacgccgctgccgctgtcactatggcccattacaaagccgccgactcgaagcgtgagcagttccggagtgttggtagccttatatgaagaaccagagaaacctaacagtgctttggattttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggt

SEQ ID NO: 357402 - DNA, 625 bp, Homo sapiens
cggcgtggctgggggcatgcgggcggtagcaagccgctggtcggctctgggtgggagtggggtcgcgcgcgcaggtttgggcgggagggccccgaggtagtgaggcggaggcggggttgccggactcccagcgccttcttcctgctcggctcccgggctctggccactgacccccggtgtctcttcaggccgccgactcgaagcgtgagcagttccggagtgttggtagccttatatgaagaaccagagaaacctaacagtgctttggattttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggt

SEQ ID NO: 357403 - DNA, 2754 bp, Homo sapiens
ggcttttagacattatatatattatcagagaagtagcctagtggtcgtggggcacagaaaaaatagataggggcagctctaaagaccagctgttaagacagacaactgcaaactcatttaagcaagagaaaaacagctctaattcgagattgtgaagcaacacttctaaattcaaagacatagagttgtcaaatcaggattttttttttttaaaatgatatcctttcgaatgtaactgattttgggaaaatcacatgttcagaattgaggctaaatggtttgatcaggttttctctttgaagagaccacagccttaggaaatggttcttgatctatacaattccaccttggacactgggttaattctgtttgcccctggaacacaatcacgtaagtttccttctagactggcatcctgatgtgtcttgagtataatcacatgttgctacctagtaaataaaatcttaagaagatccgtggctttccttcaccagttcatagcatcgtgattcattgcccggattggactcgactctactcactggacatctaaccactccacttaattaacaatacccaccctacaggggtgttgtaaggattaaaatttaaaatacccgtgttttctacagtgcctggctcaaaagctactgcaagctcgttactgctcatcctccagaggcccacatcaagtcagccacgactcaaggagactccaaagataaaagctgaagccaaaatatatgattctaaacaccctcctcggctactgcaaagcactgtgagcactttctcaggacgagagccaagaagcccagcacctatgggtcaccacagtttccgaggtcccagatgaaaaagatgcgctcgctaccaccgtgcggcggtcctttctctcgcaatagtctcaatgctcccgggccctgcctccggacgccaggacagaggtaccaaaatctcacctcctgcaaagaaacctaattgctacgggggccggaagaggaagaggtgcggctccgacagccagaggggcgggcatacgcagcctccctcggctcagcctgctactggggatgcagagcgtcctggtcgccatgaaaacaggccacacctcggcgatcccggccggtggtttgcaagtgcgcaggcgcgcgcccccttccgcgcatgagcagtgctgctcccaacccgccagtcgcggtctccggcgccagctacgccgctgccgctgtcactatggcccattacaaagccgccgactcgaagcgtgagcagttccggaggtacttggagaagtcgggggtgctggacacgctgaccaaggtgttggtagccttatatgaagaaccagagaaacctaacagtgctttggattttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggtcttaaagcaggagaatccaaagtaaatcctgaacaaaacctaaacacagccatctaactcattaccttaaaagacattctgtttattagtctgattaggaatgatggcactggttgtattttagccaagacagtttagcatggagctattccttggtgcagttcaggatatgaacacaggtacagtcattctttgaaggtgacactgttctgtatattccctataggcagctggagagatctgtgtgacacaagatgcttttgtacgggttcccatgaatcttctgctcttgtttgtgtgacatggaacaaataacttctttgccaccactttgccttagataactgtgtgtgtgtgtgccagtttgaactctgacaccacattttccttctatgcaatcatgcctgtctgataatcttgcattgctttcctctgagctttagtgggtcctagttgcacactggcctttctgtgctgtttttcaatttgcctaataatagcagttaccctgattgtaatttatgtaactttaaacaggatcacactgtaccccctgcctgccttatttgcttactgagcacaggacagaggcaatatacaactctgggttcacacacaagctgagatgagaagaggaatgagccatatattggggaaaatcatagtttgtaggtataattatatagtgcttttctccctcaaagtatttttctagccttgaattcattttatcttcattatccctgtgaagtaggtgggacaagtataaggggaagaggggtgctgaatttttaggccaaagactgatattaatacaaatcactcactaactgtagagccttgggcattatcagtgaactactctgagatttactgtcttcatctgtttaatgagtagaatgtccgtgatgcctacctcacagggttgttgtgagggtcaaatgagaatgtatgtgaaagatttgtaaatggtaaagcactatattcttgttttaacaaacaagaatgtcgacgcggccgcgaat

SEQ ID NO: 357404 - DNA, 2195 bp, Homo sapiens
cggcgtggctgggggcatgcgggcggtagcaagccgctggtcggctctgggtgggagtggggtcgcgcgcgcaggtttgggcgggagggccccgaggtagtgaggcggaggcggggttgccggactcccagcgccttcttcctgctcggctcccgggctctggccactgacccccggtgtctcttcaggccgccgactcgaagcgtgagcagttccggaggtacttggagaagtcgggggtgctggacacgctgaccaaggtgttggtagccttatatgaagaaccagagaaacctaacagtgctttggattttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggtcttaaagcaggagaatccaaagtaaatcctgaacaaaacctaaacacagccatctaactcattaccttaaaagacattctgtttattagtctgattaggaatgatggcactggttgtattttagccaagacagtttagcatggagctattccttggtgcagttcaggatatgaacacaggtacagtcattctttgaaggtgacactgttctgtatattccctataggcagctggagagatctgtgtgacacaagatgcttttgtacgggttcccatgaatcttctgctcttgtttgtgtgacatggaacaaataacttctttgccaccactttgccttagataactgtgtgtgtgtgtgccagtttgaactctgacaccacattttccttctatgcaatcatgcctgtctgataatcttgcattgctttcctctgagctttagtgggtcctagttgcacactggcctttctgtgctgtttttcaatttgcctaataatagcagttaccctgattgtaatttatgtaactttaaacaggatcacactgtaccccctgcctgccttatttgcttactgagcacaggacagaggcaatatacaactctgggttcacacacaagctgagatgagaagaggaatgagccatatattggggaaaatcatagtttgtaggtataattatatagtgcttttctccctcaaagtatttttctagccttgaattcattttatcttcattatccctgtgaagtaggtgggacaagtataaggggaagaggggtgctgaatttttaggccaaagactgatattaatacaaatcactcactaactgtagagccttgggcattatcagtgaactactctgagatttactgtcttcatctgtttaatgagtagaatgtccgtgatgcctacctcacagggttgttgtgagggtcaaatgagaatgtatgtgaaagatttgtaaatggtaaagcactatattcttgtttgttagtcctttttcctttctttgggtagacctacagtcagatgttttgttttatggatcacttattttccttactggtagactgtcgttttatagacatattcctatttcatatattctctccctgttgttagagaacctatctttgtttttggtcaaaacacacatagaaaacaaaatgatccaatgaaaactggtttaactagcaaaagccttggcacctgttggagactatgaccaagccaataaaaagggcatttaaatcagccctgttagtaggaatgtggctatggctggtgcctcttctagtcacaagtttgtttttggagggggtccagaagatcattcccttgcatagatttctcttttaccaatttgagtgcctcctacatgggcagcagtggactaagtgctgggtgtgataaagaggaatgacttaattatgagactgtatataatcaaatacagtgtgggttaggacctgtggcagaccattataataaagcatggccccgtgagggttttgaaagagaaaga

SEQ ID NO: 357405 - DNA, 3209 bp, Homo sapiens
ggcttttagacattatatatattatcagagaagtagcctagtggtcgtggggcacagaaaaaatagataggggcagctctaaagaccagctgttaagacagacaactgcaaactcatttaagcaagagaaaaacagctctaattcgagattgtgaagcaacacttctaaattcaaagacatagagttgtcaaatcaggattttttttttttaaaatgatatcctttcgaatgtaactgattttgggaaaatcacatgttcagaattgaggctaaatggtttgatcaggttttctctttgaagagaccacagccttaggaaatggttcttgatctatacaattccaccttggacactgggttaattctgtttgcccctggaacacaatcacgtaagtttccttctagactggcatcctgatgtgtcttgagtataatcacatgttgctacctagtaaataaaatcttaagaagatccgtggctttccttcaccagttcatagcatcgtgattcattgcccggattggactcgactctactcactggacatctaaccactccacttaattaacaatacccaccctacaggggtgttgtaaggattaaaatttaaaatacccgtgttttctacagtgcctggctcaaaagctactgcaagctcgttactgctcatcctccagaggcccacatcaagtcagccacgactcaaggagactccaaagataaaagctgaagccaaaatatatgattctaaacaccctcctcggctactgcaaagcactgtgagcactttctcaggacgagagccaagaagcccagcacctatgggtcaccacagtttccgaggtcccagatgaaaaagatgcgctcgctaccaccgtgcggcggtcctttctctcgcaatagtctcaatgctcccgggccctgcctccggacgccaggacagaggtaccaaaatctcacctcctgcaaagaaacctaattgctacgggggccggaagaggaagaggtgcggctccgacagccagaggggcgggcatacgcagcctccctcggctcagcctgctactggggatgcagagcgtcctggtcgccatgaaaacaggccacacctcggcgatcccggccggtggtttgcaagtgcgcaggcgcgcgcccccttccgcgcatgagcagtgctgctcccaacccgccagtcgcggtctccggcgccagctacgccgctgccgctgtcactatggcccattacaaagccgccgactcgaagcgtgagcagttccggaggtacttggagaagtcgggggtgctggacacgctgaccaaggttttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggtcttaaagcaggagaatccaaagtaaatcctgaacaaaacctaaacacagccatctaactcattaccttaaaagacattctgtttattagtctgattaggaatgatggcactggttgtattttagccaagacagtttagcatggagctattccttggtgcagttcaggatatgaacacaggtacagtcattctttgaaggtgacactgttctgtatattccctataggcagctggagagatctgtgtgacacaagatgcttttgtacgggttcccatgaatcttctgctcttgtttgtgtgacatggaacaaataacttctttgccaccactttgccttagataactgtgtgtgtgtgtgccagtttgaactctgacaccacattttccttctatgcaatcatgcctgtctgataatcttgcattgctttcctctgagctttagtgggtcctagttgcacactggcctttctgtgctgtttttcaatttgcctaataatagcagttaccctgattgtaatttatgtaactttaaacaggatcacactgtaccccctgcctgccttatttgcttactgagcacaggacagaggcaatatacaactctgggttcacacacaagctgagatgagaagaggaatgagccatatattggggaaaatcatagtttgtaggtataattatatagtgcttttctccctcaaagtatttttctagccttgaattcattttatcttcattatccctgtgaagtaggtgggacaagtataaggggaagaggggtgctgaatttttaggccaaagactgatattaatacaaatcactcactaactgtagagccttgggcattatcagtgaactactctgagatttactgtcttcatctgtttaatgagtagaatgtccgtgatgcctacctcacagggttgttgtgagggtcaaatgagaatgtatgtgaaagatttgtaaatggtaaagcactatattcttgtttgttagtcctttttcctttctttgggtagacctacagtcagatgttttgttttatggatcacttattttccttactggtagactgtcgttttatagacatattcctatttcatatattctctccctgttgttagagaacctatctttgtttttggtcaaaacacacatagaaaacaaaatgatccaatgaaaactggtttaactagcaaaagccttggcacctgttggagactatgaccaagccaataaaaagggcatttaaatcagccctgttagtaggaatgtggctatggctggtgcctcttctagtcacaagtttgtttttggagggggtccagaagatcattcccttgcatagatttctcttttaccaatttgagtgcctcctacatgggcagcagtggactaagtgctgggtgtgataaagaggaatgacttaattatgagactgtatataatcaaatacagtgtgggttaggacctgtggcagaccattataataaagcatggccccgtgagggttttgaaagagaaaga

SEQ ID NO: 357406 - DNA, 1729 bp, Homo sapiens
ggcttttagacattatatatattatcagagaagtagcctagtggtcgtggggcacagaaaaaatagataggggcagctctaaagaccagctgttaagacagacaactgcaaactcatttaagcaagagaaaaacagctctaattcgagattgtgaagcaacacttctaaattcaaagacatagagttgtcaaatcaggattttttttttttaaaatgatatcctttcgaatgtaactgattttgggaaaatcacatgttcagaattgaggctaaatggtttgatcaggttttctctttgaagagaccacagccttaggaaatggttcttgatctatacaattccaccttggacactgggttaattctgtttgcccctggaacacaatcacgtaagtttccttctagactggcatcctgatgtgtcttgagtataatcacatgttgctacctagtaaataaaatcttaagaagatccgtggctttccttcaccagttcatagcatcgtgattcattgcccggattggactcgactctactcactggacatctaaccactccacttaattaacaatacccaccctacaggggtgttgtaaggattaaaatttaaaatacccgtgttttctacagtgcctggctcaaaagctactgcaagctcgttactgctcatcctccagaggcccacatcaagtcagccacgactcaaggagactccaaagataaaagctgaagccaaaatatatgattctaaacaccctcctcggctactgcaaagcactgtgagcactttctcaggacgagagccaagaagcccagcacctatgggtcaccacagtttccgaggtcccagatgaaaaagatgcgctcgctaccaccgtgcggcggtcctttctctcgcaatagtctcaatgctcccgggccctgcctccggacgccaggacagaggtaccaaaatctcacctcctgcaaagaaacctaattgctacgggggccggaagaggaagaggtgcggctccgacagccagaggggcgggcatacgcagcctccctcggctcagcctgctactggggatgcagagcgtcctggtcgccatgaaaacaggccacacctcggcgatcccggccggtggtttgcaagtgcgcaggcgcgcgcccccttccgcgcatgagcagtgctgctcccaacccgccagtcgcggtctccggcgccagctacgccgctgccgctgtcactatggcccattacaaagccgccgactcgaagcgtgagcagttccggaggtacttggagaagtcgggggtgctggacacgctgaccaaggtgttggtagccttatatgaagaaccagagaaacctaacagtgctttggattttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggt

SEQ ID NO: 357407 - DNA, 1680 bp, Homo sapiens
ggcttttagacattatatatattatcagagaagtagcctagtggtcgtggggcacagaaaaaatagataggggcagctctaaagaccagctgttaagacagacaactgcaaactcatttaagcaagagaaaaacagctctaattcgagattgtgaagcaacacttctaaattcaaagacatagagttgtcaaatcaggattttttttttttaaaatgatatcctttcgaatgtaactgattttgggaaaatcacatgttcagaattgaggctaaatggtttgatcaggttttctctttgaagagaccacagccttaggaaatggttcttgatctatacaattccaccttggacactgggttaattctgtttgcccctggaacacaatcacgtaagtttccttctagactggcatcctgatgtgtcttgagtataatcacatgttgctacctagtaaataaaatcttaagaagatccgtggctttccttcaccagttcatagcatcgtgattcattgcccggattggactcgactctactcactggacatctaaccactccacttaattaacaatacccaccctacaggggtgttgtaaggattaaaatttaaaatacccgtgttttctacagtgcctggctcaaaagctactgcaagctcgttactgctcatcctccagaggcccacatcaagtcagccacgactcaaggagactccaaagataaaagctgaagccaaaatatatgattctaaacaccctcctcggctactgcaaagcactgtgagcactttctcaggacgagagccaagaagcccagcacctatgggtcaccacagtttccgaggtcccagatgaaaaagatgcgctcgctaccaccgtgcggcggtcctttctctcgcaatagtctcaatgctcccgggccctgcctccggacgccaggacagaggtaccaaaatctcacctcctgcaaagaaacctaattgctacgggggccggaagaggaagaggtgcggctccgacagccagaggggcgggcatacgcagcctccctcggctcagcctgctactggggatgcagagcgtcctggtcgccatgaaaacaggccacacctcggcgatcccggccggtggtttgcaagtgcgcaggcgcgcgcccccttccgcgcatgagcagtgctgctcccaacccgccagtcgcggtctccggcgccagctacgccgctgccgctgtcactatggcccattacaaagccgccgactcgaagcgtgagcagttccggaggtacttggagaagtcgggggtgctggacacgctgaccaaggttttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggt

SEQ ID NO: 357408 - DNA, 697 bp, Homo sapiens
tgtgaatcactgacttcactaatggcctgctttcctcacaagaagacaacttggactcagatgaagaccagtccctttctgcagtttcctttaacacagcaagatagccagcacttccaggtgaaatctcccttaagactagcagagaattggaactttttctgttactttcttcagagctatatcgacgtatctggacaagtgataaaaaacaatagctattatggtctacggtgtgccagccactgtttaagggctttatgtatgttaactttggagatgggtgccgttttccaggtgagggaactgaaacttgggggaaattaagtcagggtcacacagccagaaagtggccactaggatctcaaccaaggcagtgtggcttcagagtttgtgctcacaagtgctgtctgtagtgccattcaaataaaaaaggtcacatgccacaagctaggctgattcccagcaccttcccccaaaagaatgtaaagggaagaaccaggacactactatcagcaactctttatccagtttttcatggagacaacggttgacctgtttggacaatggacattacagtgattgattggcaggatgcatgacacgctgggcttgaaaagggactgtttgtatggcaccccactttttaccagcagagctctgaaaaaggcaataattagaatcatgcaaaagcata

SEQ ID NO: 357409 - DNA, 2101 bp, Homo sapiens
ctcttctcgccagccaatggaagcggtctgcctagccctcgcgggggcaaggcggcgaccgaggcgcgtgggtctgggaaggcgcgcggatttggcccctcttctcacatcagcgggtccaggcccaaccgacagactatgggggctccggcaaccaggcgctgcgtggagtggctgctgggcctctacttcctcagccacatccccatcaccctgttcatggacctgcaggcggtgctgccgcgcgagctctacccagtcgagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaacccacgtcttcagcagcatttgaaacactggcagcaatgcacaagagcaagatggtgtcaggaaccatgtcaaaccctcaccttcttccattttttttttttttttaagacagtctcactctgttgcccaggctggagtaaagggcagtggcatgatctcggctcactgcaacctccgcctcctgggctcaagccatcttccttagcctcccaagtagctagaactacaggtgtgtaccaacacgtatggctaatttgttttgttttttttgtgtgtgtggagacagggttttgccatgttgcccaggttggtctcgaacgcctaggctcaagtgatctgcccacctcagtctccctaagtgctgggattacagacgtgaaccactgggcccagcccaaaccttcaccttctaagggcactgggatgaacagaccgatcggcttgagggtgggcaaaggggtgtgggctaggttataaggaagtggtaccaaataactgtgtgcctgagttccaccgcaagattactaaaagcaggaccagaccagaaactgctaaagaacatggcctgtttgacatgttcatgagtcacctgacccacagcatatatgcttatgactaaaccctccactcctgattctcaagagtgtatcacctgtcagcaaaatgaatagtgggatattttgggccattttaaatgtgaaattttgcctctttaatgttaattcaaaactatatcaatgttttcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgtttgtttgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtctttgctcaagttcaaccttaaaatgatgttagacaacaggtcccagtcagttccctctattttcacccattttgctcacaagccatattggcccgattagtggtactgtctgactcacgtgtgtgatccaaataaaggtagctgctgacca

SEQ ID NO: 357410 - DNA, 1043 bp, Homo sapiens
actctgggttccagttgcctctctcgggtcctgcccatgcctcccccgctcctaacccaactttagttcggtgttttcctcgggctttgtctctatcccagccccttctcccaagcggcgggggcgaacgctttgtttcctttaaagtcacttcttccctgggtttaaggtttcccgcgattccacctctggccggttgtcagtgtctgagggaagtagtctggatgaagtggtgtccaaagtcacatgttaggtttgctttaagcttctggttttttgtttgtttgtttggaagggctttaaaataccagtctgatcccaaagaaaaaatccgagtagaaatagacctgtctgaaggtttagcaccttggttggtgcagctggggcgttcacagatcgtcactgcttcgagatcaggttccagcaacttccagagctcaggagtaaattgccatcttttcagattggctcttcaatattgggttcgagtaacaatgatctcctgagtaaaaataaaggtgaaaatcccgatttcctggttgttggagagcattctttcaaccccaaactctgctttaatgctttgtttttttcttcaaagctatagttttagtttcccggttcgttgaggtttttttctcgtatctggaccctgtgaccttcttccatggaattcctgtcctcagttttgtttctccatcttatctataactgtaggcaggactgacttgtctacccgaagattttattttgcgtctgtttttccttaaatgctttttatctgccgaggaggggttctttacctgagggtcatgaactcccaaaaatgggtgcaagtgtgtgtgccttttgtttcctgcaaggagaatatagcttccatcgacttttcaaggggcctaactctcccaaaaaggccacggctcaagaatgttctaccactcccataagtcactcttttttgtttgcttctagaaccaaacacaactggaagacctctgacctccttttgcatgggaaaagcgtaggtagcgtgtagcaagttg

SEQ ID NO: 357411 - DNA, 2120 bp, Homo sapiens
actctgggttccagttgcctctctcgggtcctgcccatgcctcccccgctcctaacccaactttagttcggtgttttcctcgggctttgtctctatcccagccccttctcccaagcggcgggggcgaacgctttgtttcctttaaagtcacttcttccctgggtttaaggtttcccgcgattccacctctggccggttgtcagtgtctgagggaagtagtctggatgaagtggtgtccaaagtcacatgtcagcatggatccgcatcctttttatttgacaagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaacccacgtcttcagcagcatttgaaacactggcagcaatgcacaagagcaagatggtgtcaggaaccatgtcaaaccctcaccttcttccattttttttttttttttaagacagtctcactctgttgcccaggctggagtaaagggcagtggcatgatctcggctcactgcaacctccgcctcctgggctcaagccatcttccttagcctcccaagtagctagaactacaggtgtgtaccaacacgtatggctaatttgttttgttttttttgtgtgtgtggagacagggttttgccatgttgcccaggttggtctcgaacgcctaggctcaagtgatctgcccacctcagtctccctaagtgctgggattacagacgtgaaccactgggcccagcccaaaccttcaccttctaagggcactgggatgaacagaccgatcggcttgagggtgggcaaaggggtgtgggctaggttataaggaagtggtaccaaataactgtgtgcctgagttccaccgcaagattactaaaagcaggaccagaccagaaactgctaaagaacatggcctgtttgacatgttcatgagtcacctgacccacagcatatatgcttatgactaaaccctccactcctgattctcaagagtgtatcacctgtcagcaaaatgaatagtgggatattttgggccattttaaatgtgaaattttgcctctttaatgttaattcaaaactatatcaatgttttcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgtttgtttgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtctttgctcaagttcaaccttaaaatgatgttagacaacaggtcccagtcagttccctctattttcacccattttgctcacaagccatattggcccgattagtggtactgtctgactcacgtgtgtgatccaaataaaggtagctgctgacca

SEQ ID NO: 357412 - DNA, 1108 bp, Homo sapiens
cggccgggcgcggtggctcacgcctgtaatcccagcactttgggaggctgaggcgggcggatcacgaggtctcgaacgcctaggctcaagtgatctgcccacctcagtctccctaagtgctgggattacagacgtgaaccactgggcccagcccaaaccttcaccttctaagggcactgggatgaacagaccgatcggcttgagggtgggcaaaggggtgtgggctaggttataaggaagtggtaccaaataactgtgtgcctgagttccaccgcaagattactaaaagcaggaccagaccagaaactgctaaagaacatggcctgtttgacatgttcatgagtcacctgacccacagcatatatgcttatgactaaaccctccactcctgattctcaagagtgtatcacctgtcagcaaaatgaatagtgggatattttgggccattttaaatgtgaaattttgcctctttaatgttaattcaaaactatatcaatgttttcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgtttgtttgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtctttgctcaagttcaaccttaaaatgatgttagacaacaggtcccagtcagttccctctattttcacccattttgctcacaagccatattggcccgattagtggtactgtctgactcacgtgtgtgatccaaataaaggtagctgctgacca

SEQ ID NO: 357413 - DNA, 2511 bp, Homo sapiens
ctcttctcgccagccaatggaagcggtctgcctagccctcgcgggggcaaggcggcgaccgaggcgcgtgggtctgggaaggcgcgcggatttggcccctcttctcacatcagcgggtccaggcccaaccgacagactatgggggctccggcaaccaggcgctgcgtggagtggctgctgggcctctacttcctcagccacatccccatcaccctgttcatggacctgcaggcggtgctgccgcgcgagctctacccagtcgagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaacccacgtcttcagcagcatttgaaacactggcagcaatgcacaagagcaagatggtgtcaggaaccatgtcaaaccctcaccttcttccattttttttttttttttaagacagtctcactctgttgcccaggctggagtaaagggcagtggcatgatctcggctcactgcaacctccgcctcctgggctcaagccatcttccttagcctcccaagtagctagaactacaggtgtgtaccaacacgtatggctaatttgttttgttttttttgtgtgtgtggagacagggttttgccatgttgcccaggttggtctcgaacgcctaggctcaagtgatctgcccacctcagtctccctaagtgctgggattacagacgtgaaccactgggcccagcccaaaccttcaccttctaagggcactgggatgaacagaccgatcggcttgagggtgggcaaaggggtgtgggctaggttataaggaagtggtaccaaataactgtgtgcctgagttccaccgcaagattactaaaagcaggaccagaccagaaactgctaaagaacatggcctgtttgacatgttcatgagtcacctgacccacagcatatatgcttatgactaaaccctccactcctgattctcaagagtgtatcacctgtcagcaaaatgaatagtgggatattttgggccattttaaatgtgaaattttgcctctttaatgttaattcaaaactatatcaatgttttcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgtttgtttgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtctttgctcaagttcaaccttaaaatgatgttagacaacaggtcccagtcagttccctctattttcacccattttgctcacaagccatattggcccgattagtggtactgtctgactcacgtgtgtgatccaaataaaggtagctgctgaccaaaaaaaaaaaaaaaaaaaaaaaaaaggggggggggtaaaagtttccccgggggggcccaagtttggggtacccggtttttttgtccaaggggggcccctatataggggaggtcggtataattaaggctagggcactgggccggttggttttaaacaacggtcggtgcagcgtgcgaaaattggctacggtggggactctttggggaagggagcctttactttttgggggggggtgacattatttgggacaaaacttcccttacaggagaatttaaaggctctagaggaaatttacaaacttttttcaaggttgtcatatggtgttaaaccatagggggtagtatgcttgggggtttgaaaaagtttggatagacgggggttatgacttgttgtgaaaactcttttcccgg

SEQ ID NO: 357414 - DNA, 756 bp, Homo sapiens
ggcacgataactggaagtactttgttttcagtgttgtatatgcccttaagcaatatggcaacaggacctgaatgcccgcacaagagttttcaagtgctgtgccccatagcacatagtgctgtgtcctgaaccagctccccgtggctgtgtggggaagttgttgccggctttgttctgatggcttggaactggcttcagtgacgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggata

SEQ ID NO: 357415 - DNA, 800 bp, Homo sapiens
ggcacgataactggaagtactttgttttcagtgttgtatatgcccttaagcaatatggcaacaggacctgaatgcccgcacaagagttttcaagtgctgtgccccatagcacatagtgctgtgtcctgaaccagctccccgtggctgtgtggggaagttgttgccggctttgttctgatgggtaatgtgattacttagtgtccgttaacctaaacgatcagtgacagaagtgacttttataaatcacaaatgttttggccaccaatctacattgtcaccattttgcattatttagaatagatttttaaatgagctattgtcaggacaaaaggcaaaaagaatccttaagactctcaatgcaaaaggggctttccaggtgacgtttatattggtgattattgcccacttgctgcgtatctgccagcatccagcattactgctaatttttagcctttcctattttggtaggtgaaagaagctcttggcagtgttaacattggagatgggctgggcatggccactcacgcctgtaatcccagcactttgggaggctgaggtgggaggatcacttgagcccaggagttcgggaccagcctgggcaacatagtgagaccccacctctacaaaaacttttttaaaaaattagccaggcgtggtggcgcatgcctgtggtcccagctacttgggaggctgaggcaggaggattgcttgagcccaggaggtggaggttgcagtgagccaagattgcaccactgcactccagcctggataacagagctacaccctgtctcaaaaaaaaa

SEQ ID NO: 357416 - DNA, 184 bp, Homo sapiens
tacatgtaccgggcttgcatgtacccttgcatgtacccttgcatgacgggcagagggcacagatccacgccctggaaggcggggaggtgaagatcttcagcaggaatcaggaagacaacactgggaagtacccggacatcatcagccgcatccccaagattaaactccccccggtacatgcaag

SEQ ID NO: 357417 - DNA, 3062 bp, Homo sapiens
ggcgggggccacctggaagtgctgagggggcggggctagaagaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaagaggagaccccgaaagaaagcctcacagaggctgaagtggcaacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgacgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggata

SEQ ID NO: 357418 - DNA, 3252 bp, Homo sapiens
cggagggcggcgggtgcgccgaatgcttggggcctatgcttcgccatgtcggggtgtctgcagaggagtgggcgtggggacgctgaggctgccgagagcgcggtggagacggaagagcgcgggctgcgggccgccggagagtgcagagaggtgtctcccagagggaggggggccaggtagagggtagacgagagacagagacagttggacaggtcctctgagaagaggccttgaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaagaggagaccccgaaagaaagcctcacagaggctgaagtggcaacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgacgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggata

SEQ ID NO: 357419 - DNA, 3105 bp, Homo sapiens
ctccgcgcgacggcggcggtgcggacggtgcccaggtcccgcccctaggctctgccccgcccccgcccgcagacgtctgcgcgcgaatgccgtggcgcgaacttgggactgcagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaagaggagaccccgaaagaaagcctcacagaggctgaagtggcaacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgacgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggata

SEQ ID NO: 357420 - DNA, 1197 bp, Homo sapiens
ctgaggacctcgaatcgtggtgctgcttctttacccggacatatcagcgcatcccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgacgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggata

SEQ ID NO: 357421 - DNA, 1379 bp, Homo sapiens
ggaggccgacgcaagacagtcgcttgaattcaggaggcggaggctgcagtcagccaagattgcaccaccgcactccagcctgggcgacagagcgagattccgtctcaaaaaaacaaaaacaaaaaacaaaactgatgagatgcccgtaaagtgttaattcaagctccagcaaggccgcagccccccgtctgatgctcctgaagtcaccgactctaaatggtgtcgggccctcttgccagtgactagccccatgctttaagctctcagaatccttctgacatcagggttcttccctctcaaggctttccacgaaccctgtcactagttgtgacccgcacatgtcctgttcgcctcacatttagggcttattgtctttattctcacaaagatgtctcatctctcttctccctgccggccctgcagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgacgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggata

SEQ ID NO: 357422 - DNA, 1431 bp, Homo sapiens
ctccgcgcgacggcggcggtgcggacggtgcccaggtcccgcccctaggctctgccccgcccccgcccgcagacgtctgcgcgcgaatgccgtggcgcgaacttgggactgcagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaagaggagaccccgaaagaaagcctcacagaggctgaagtggcaacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttggggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggata

SEQ ID NO: 357423 - DNA, 1193 bp, Homo sapiens
  misc_feature (807)..(807): n is a, c, g, or t
  misc_feature (809)..(809): n is a, c, g, or t
ctccgcgcgacggcggcggtgcggacggtgcccaggtcccgcccctaggctctgccccgcccccgcccgcagacgtctgcgcgcgaatgccgtggcgcgaacttgggactgcagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaagaggagaccccgaaagaaagcctcacagaggctgaagtggcaacagagaaggaaggagaagacggggaccagcccaccacgcctcccaagcccctaaagacctccagnanagacccgacgacagcgtcagagctagaggtggaccaggaagcaggagccgcacgatgacggagaccgacaagctcgcgcagaagtcccaacaggccagcacttctcaccaccggacacaggtcaaaaaactgaagaaaagaacaggtcagcaagcaggccaccgagacccgagctacaggttcgctggcgtctccattttggacggacagccctggtgcacaacgcaaagatcctaacgtgctgacgagttaaaatatacaagtctgtaccgaggtgagatacacaaccacagccgttccactacacgcagacacaagaacacacgcaacgatggttctaccagagccaccgacagttcataaagcaagagacacttagctgct

SEQ ID NO: 357424 - DNA, 671 bp, Homo sapiens
tctctacatctctgtccctgtcccactgtgtctctgtctccttcctccaggtctctggccctttctctgcctcttttgtctttaatgtcctgcctcagcccccagggcctttcatttctttccatctcccattcctcccaactcccacctttctcaactttttacttcaagggggtcttgtttcttttcccttctttcactttctgtttctctttctatttctgtttacttcaagggggtgtcttgtttcttttcccttatttcacttcctatttctgtttacttcaagggggtgcctgtttttttcccttcctccctctccccagccctccaacacttggtcttgactttgagattccagaccctctgttcctctcttcctctgctcactgcaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtgagtggcagaggacctggccgtggccctgtgtgggattctgggcgggcacacagagagcagagtagggaggggaccttggctcacatctgctcttccaggtaaggatcaggaagatgagcttgcatttta

SEQ ID NO: 357425 - DNA, 3191 bp, Homo sapiens
ctccgcgcgacggcggcggtgcggacggtgcccaggtcccgcccctaggctctgccccgcccccgcccgcagacgtctgcgcgcgaatgccgtggcgcgaacttgggactgcagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaagaggagaccccgaaagaaagcctcacagaggctgaagtggcaacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgacgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggata

SEQ ID NO: 357426 - DNA, 1127 bp, Homo sapiens
  misc_feature (741)..(741): n is a, c, g, or t
  misc_feature (743)..(743): n is a, c, g, or t
tggaggaagaggatggccagtgttgacggatgagcagaagtcccgaatcaggccatgaagcccatgaccaaggaggagtgggatgcgcggcagagcatcatccgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaagaggagaccccgaaagaaagcctcacagaggctgaagtggcaacagagaaggaaggagaagacggggaccagcccaccacgcctcccaagcccctaaagacctccagnanagacccgacgacagcgtcagagctagaggtggaccaggaagcaggagccgcacgatgacggagaccgacaagctcgcgcagaagtcccaacaggccagcacttctcaccaccggacacaggtcaaaaaactgaagaaaagaacaggtcagcaagcaggccaccgagacccgagctacaggttcgctggcgtctccattttggacggacagccctggtgcacaacgcaaagatcctaacgtgctgacgagttaaaatatacaagtctgtaccgaggtgagatacacaaccacagccgttccactacacgcagacacaagaacacacgcaacgatggttctaccagagccaccgacagttcataaagcaagagacacttagctgct

SEQ ID NO: 357427 - DNA, 3125 bp, Homo sapiens
tggaggaagaggatggccagtgttgacggatgagcagaagtcccgaatcaggccatgaagcccatgaccaaggaggagtgggatgcgcggcagagcatcatccgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaagaggagaccccgaaagaaagcctcacagaggctgaagtggcaacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgacgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggata

SEQ ID NO: 357428 - DNA, 3101 bp, Homo sapiens
ctccgcgcgacggcggcggtgcggacggtgcccaggtcccgcccctaggctctgccccgcccccgcccgcagacgtctgcgcgcgaatgccgtggcgcgaacttgggactgcagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaagaggagaccccgaaagaaagcctcacagaggctgaagtggcaacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgacgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggata

SEQ ID NO: 357429 - DNA, 3340 bp, Homo sapiens
ctccgcgcgacggcggcggtgcggacggtgcccaggtcccgcccctaggctctgccccgcccccgcccgcagacgtctgcgcgcgaatgccgtggcgcgaacttgggactgcagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaagaggagaccccgaaagaaagcctcacagaggctgaagtggcaacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaaggtcctggggaactggggctgatggcagaagcaggagggaaggagattagactcccgggggtatttcctattgcacaacccagaccgaggggtgctcacatccccctgtgaaggatccgttctccccagtttttatttactttttctggttctatgagcaactcttgcttcatatagaaaaacaggctgggatagaaagatgtcaggaatgtgtgtcagtgagagattgagattagctacaaatagtggtggctcacataagaaaagaatttttttgttatgaaatgagaagtgtggagggggcagtctgatgccattagggattcaggttcctcctctccccacatttttttttgtccccacattttttttttctgccatgtgcctctggcctcatcatcacaatgtggctgcaggagttccagccctcatggccatgcctgctccacgcaccagggaagagcaaagggggttggaccctgagtcagcctcagccagtgaacaccttctgctcaagttctgttgctcatcactttgctccatggctcacccctagctgcaaggaattctgggaaatgtaaagtgatttactttttttcaagttaaagtttttcttaaagctgtgcacattttggactagattttctccagcctgtttttactcttactttgaaacagctgtttcaaatgactcgtaatctgcttaaatcctacatgctttttta

SEQ ID NO: 357430 - DNA, 893 bp, Homo sapiens
cactgtgtctctgtctccttcctccaggtctctggccctttctctgcctcttttgtctttaatgtcctgcctcagcccccagggcctttcatttctttccatctcccattcctcccaactcccacctttctcaactttttacttcaagggggtcttgtttcttttcccttctttcactttctgtttctctttctatttctgtttacttcaagggggtgtcttgtttcttttcccttatttcacttcctatttctgtttacttcaagggggtgcctgtttttttcccttcctccctctccccagccctccaacacttggtcttgactttgagattccagaccctctgttcctctcttcctctgctcactgcaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggata

SEQ ID NO: 357431 - DNA, 458 bp, Homo sapiens
ttatggccttgacttcgtagcaaagctactgtggcagcctgtgaattttaagagtcaggggaggggtgtgtgtgtgagggggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggata

SEQ ID NO: 357432 - DNA, 325 bp, Homo sapiens
gagggattgaagggtgcggcctgcactggggcagtgactgtgtgcaggcagagaaggggagagggcccagagccttccagaggctacatcagtgggtgtgagctctccgggatgggagcacacgagccagcgaggtcagatacaccaagccctttgcctccccagctcggaagcagctcccgaaacggaccattcaggaagtcctggaagagcagagtgaggacgaggacagagaagccaagaggaagaaggaggaggaaggtgagcccccagaaggagagaagtgtgtgtgtgtgtgtgtgtgtgtgtgtgaagccaagaggaa

SEQ ID NO: 357433 - DNA, 482 bp, Homo sapiens
tttctgcatctattgagatggtgatatgggtttgtcttatagccacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaacggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatggtgagtttggggaaaatagagt

SEQ ID NO: 357434 - DNA, 360 bp, Homo sapiens
ccggctcgatcttagctgctaattggggaaagtgttatttcatatggaaaagtaataccaagtaggttaggaaatggcagcagcacaacgcatgctgaggggtgatttactgcacttaaatcatttagcagtataagttaactctttgccccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcctgggttcaagcaattctcctgcctcagcctcccaagt

SEQ ID NO: 357435 - DNA, 3260 bp, Homo sapiens
cacgggcgcgaccatctgcgctgcggcgccggcgactcagcgctgcctcagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaacggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgcggatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaacaaatcccagtctctgaccaatgccttcaaccttccagagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 357436 - DNA, 3183 bp, Homo sapiens
cacgggcgcgaccatctgcgctgcggcgccggcgactcagcgctgcctcagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaacggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgcggatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaacaaatcccagtctctgaccaatgccttcaaccttccagagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 357437 - DNA, 2565 bp, Homo sapiens
cctgcgcctttcagaaccaatgagccggaacggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgcggatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaaagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 357438 - DNA, 1830 bp, Homo sapiens
ctcctccagggcctcccaggcacctggctgacccaccctctgcaacttcctgcccagcccagagccttccctgccaaactcgcccccccgccaccaacccatccctaaaactcctggcccgagtcctagtcctcctatcatctggctcttcccactccatcctcatacttttcctcctccttcacatccttctggcccatctcagtctccccgcgaatcatcacccatctgccttttctggtccattccaactcccatcccagctcagacgtcctccctgccccacccagctgctctgccttaggctgacttgcccaacagcctgtccttggtccaagccctttctatgccctcctagacacctcacccttagattggaaacttccctgctcatcttcccctttgtatcaaactagccaagaattcacagagaaggttctgcccaggactcttgccacgaatcccacacttcaccctggatccaagtcctcccagcctgtcccagatctcgcctccctggcccaggactccacccactccacctgagtgctcccagccttgagaacctgttagggtccaggcccatggtggcaggtggggaggtcacaggcacagccccaggatcagaggggcagggctggggctgggcctggggtaacgttgtgtttctctccccttcctccccttcctcttcccccttcctcccaggcctccaccttgtctctctctagcaaatcccagtctctgaccaatgccttcaaccttccagagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 357439 - DNA, 3183 bp, Homo sapiens
cacgggcgcgaccatctgcgctgcggcgccggcgactcagcgctgcctcagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaacggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgcggatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaacaaatcccagtctctgaccaatgccttcaaccttccagagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 357440 - DNA, 3222 bp, Homo sapiens
cacgggcgcgaccatctgcgctgcggcgccggcgactcagcgctgcctcagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaacggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgcggatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaaagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 357441 - DNA, 2701 bp, Homo sapiens
ttctggacacgcacgtcatatttggcatcgatgaagggctcggcagtggcatacgtcttggtcagtgccacgacacttgcgatgtcctggaagtcatgctggttgtcaaccttgaccttgcccatgccaatggtggattctctgtggatatggaagttcttcggaacggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgcggatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaaagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 357442 - DNA, 407 bp, Homo sapiens
ggcgccagcccttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacaga

SEQ ID NO: 357443 - DNA, 14790 bp, Homo sapiens
tcttggagcgttctcagtttctcaacagatcttcacttgctaggcagccagaagccggcggcagtggcggcaccgcctcctcctcacattcccggggtggcggggttagatgagcggccccagtcgcggcgccgggggcgctgttcatgccggttcccgacggctccgtggctgctgcggggctggggctggggctacccgccgcggactccccgggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaagtgctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaattaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacacgtaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaccacttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacgaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtcta

SEQ ID NO: 357444 - DNA, 674 bp, Homo sapiens
cgactctagagatccccctcgcgaacgtgttatccttgtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggataacacgttcgcgagggtacacgagctcgattcgtatctgtctactc

SEQ ID NO: 357445 - DNA, 649 bp, Homo sapiens
tattgtttttcgcctcactccagcatgagaaagaaaagagaggctggccgcatcagtttttatttttatttttgtacttcaaaaagtgataagttcacgtaaactacatgccattattattcataatgataattgcattttctatacaatcgatatcatttccatttttattataaaacagcagactggtttctgtcataaaacaaatctggcttgtattagaacaaatacatcctcatttaaagaattttaaggtttctttcttgcattgagtatcttaagctttataacaacgtctggctcttaattttagtaaatggcatgacacactatatccatggagagcttctgacaaaaacttacttatcagacagaatttcttcggtgtgttgtttactcagatggcttcagtttctctttagtaaaataatatttccatgttggtgctagagtacagaaaaatgttgttactgtgcacgcatcttctgcagatgatatcctgttccctttctttgttgatatttttctttcttaaactttgttgctcagaatatctttaatgctagccaaggagtcagggatttggacgtattttcatggacttccaaagcttttttcccccaggtgagttaactttaatctttattaa

SEQ ID NO: 357446 - DNA, 15122 bp, Homo sapiens
tcttggagcgttctcagtttctcaacagatcttcacttgctaggcagccagaagccggcggcagtggcggcaccgcctcctcctcacattcccggggtggcggggttagatgagcggccccagtcgcggcgccgggggcgctgttcatgccggttcccgacggctccgtggctgctgcggggctggggctggggctacccgccgcggactccccgggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaagtgctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcagagacttaggaatgccattagagctcatagcaggagtataagaactacgttcatggaaagcctcccagaggatatgaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaattaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacacgtaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaccacttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacaatatctttaatgctagccaaggagtcagggatttggacgtattttcatggacttccaaagcttttttcccccaggaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaagttttgactgttttacccactgcaggtgaccaactgagtgccatattgaattccattcagtcacgacccaatctcccagctccttccatctttgatcaagctgcaaaacctccctcttccctagtacacagcccatttgtgttcggacagcccctttccttccagcagcctcagcttcagagtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtcta

SEQ ID NO: 357447 - DNA, 8516 bp, Homo sapiens
atcacatctgtttatctgtgctctcccaagacagcattgatagttagaattctaaattgggatttttttaacccttttttcaaaacttagccccatctgttaatactgtatttataaaacagagcacataatatgataaaggaggttaatgattgaataatgaagctttgcaagaaactaaaaagcattatgttttagttacttttattcatccaaagaacaggaaaaattatcttaaatattggcatgttgcaattaaacatttagttcatcagtgtgccctgtataaagtacttgccatactctattatttcaccatgtaattactcagtttgcaagcatctaacccttgcacatcaataactaatgtcacctctgtcctgtggccttgggagccttaattgtaaaaagtagacttctggagaagctgaatacttgggagtagcagaagaaaaaaatcaagaaaattggaatatattactcattcaacacatatttattgaatacctactgtattcctggattcattcttggtattacatcagtgaagagtaacagacaaaaatacctgcccttgacaaagactggggcagattctccagcactactgtcctgagccatagagaaatagagcgtgactatacacacttaacacatgcacggaagcataaaaaacattttcctacatcatctgaatttgttcacatccttttttcttttaaaaaataataacatgcagttatagccagttaacaaatctaccttaatttcctaggaactgtctttgaaaaaatataaatacttccagataggtttatggattttcagttttttataccacttgaaacccttcagtcagattgcttttctcctaacaactaactggtatcacttgcactaagagtagaagtttttattttaaggaggaaaggtgatgttgaagtttgtaccatttacttgggtcacagacagcctggctctaatgcctcaaagaaaagcataaaatagaatgaaggagagacactgaatgaaggcagggtgctaaaaacaattaatgtccatgcagaaacatctaatgctttgccttagaaaagggaggtgattcttcttttcatcctgtttttctgtcattctcctgactccttgttttgagggtccacagttcagacttttaccactcattctgaggatccaccgtttctgtggtttccaagggaacacaggctctgagttctaagcagctaagcttcctgaacttttggagtgtaacctgtttataaataattaaataacagcttcagggcattcatgtgctcattgtaaactagtctaatctgatcataaaacagagtgcctcttaagcaactctttgttagcctaattgtatgcatacacttaaaaattataattgtgtctatgcataaattcagttctctaattcaacaaaacccataccgttgccctaaggatgcgaggtatcactctgctggaaatttagctctactctacatttaaaatacaagttttcacattaaataatttcttattccccaaaagattaatttctgtctctttctagtccctcactgaatttaaattctaactagttattgcactagggcagaggttgagatatcactgatagttcacactggatttgttcaacctgttgttttgcgtccatgaaaatagtttttggtggtaatgttgtgtaatgatgtgtagaaattttattagaaatatttcccccttctttcctttattcttcaagtattttagtatgtatgacaaacaatataaattttgtagctatgtttttttatttcagtgtttagtggctaaattatcagtaagttataattttattaataagtttcactgtaaaatggaccatacaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtcta

SEQ ID NO: 357448 - DNA, 7266 bp, Homo sapiens
  misc_feature (22)..(22): n is a, c, g, or t
gagggatccctttattcgtgtngcacatccataatgatgatggtgtgtggctgaggctgaatgatgagacaataaagaagtatgtccctaacatgaatggttacactgaagcctggtgcctctcttttaatcaacatcttggcaagagtcttctggtccctgttgacgaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtcta

SEQ ID NO: 357449 - DNA, 7525 bp, Homo sapiens
gaagctatcgagaatcataccgtctgcatctcggccatcgatgggttagtagatcatgtgccagtatcttggtactcataagaaaatacgtagccaataaatagtgtgagaactactaaggaaataaaattgagtccacggcaggagatctgaacctactgatactatcgtgcatggaattcttgggctctgacagtgtcgtacaccaatatgcaacaacctccatttcaaagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacgaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtcta

SEQ ID NO: 357450 - DNA, 6654 bp, Homo sapiens
gtaaaaaccggctttctagatggtgttgatgagaaggcatgtctgtattagaatctccctacagagactctgccaaaggggccccattggcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtcta

SEQ ID NO: 357451 - DNA, 14067 bp, Homo sapiens
tcttggagcgttctcagtttctcaacagatcttcacttgctaggcagccagaagccggcggcagtggcggcaccgcctcctcctcacattcccggggtggcggggttagatgagcggccccagtcgcggcgccgggggcgctgttcatgccggttcccgacggctccgtggctgctgcggggctggggctggggctacccgccgcggactccccgggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaagtgctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcagagacttaggaatgccattagagctcatagcaggagtataagaactacgttcatggaaagcctcccagaggatatgaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaattaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacacgtaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaccacttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacaatatctttaatgctagccaaggagtcagggatttggacgtattttcatggacttccaaagcttttttcccccaggaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggataacacgttcgcgagggtacacgagctcgattcgtatctgtctactc

SEQ ID NO: 357452 - DNA, 2745 bp, Homo sapiens
ggcaaacagactttctcagggtgttcattgaattaaaatatttaggagtaatatttaggaacacctaaattatatgatagttaaatgtttgttcattacaaatcaaggtagcaaataaaggtagttgcagtttgaacctgtttatattttaggttcctgtaatactcatctaaagcagttagcttcactgtgtaaattttatgctaagtgacaaacttctcaaacatagataaccttagtatttctgttatgtttttatcagatgtgagagtaattgcccttgatttccaggaaaagagtattgagaacttaattttttatttatttatttttaaatatcaaaatgatgattagaagttgaattttccataggatcacgaagaaattttagttcaaaagtttgtgcccataatctaaaattccatggtctcactaaaaacaaatatttcctttgataggagatgttatttaagaaaaaagagtttactatggtaatacatttctggtcacttattaaaatactctgttctgctcaatagggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtcta

SEQ ID NO: 357453 - DNA, 1789 bp, Homo sapiens
cactaactagctgtgtggtgtcgagcaagtcacttaacctctggaactcattgacttcatttataaagcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtcta

SEQ ID NO: 357454 - DNA, 10910 bp, Homo sapiens
tcttggagcgttctcagtttctcaacagatcttcacttgctaggcagccagaagccggcggcagtggcggcaccgcctcctcctcacattcccggggtggcggggttagatgagcggccccagtcgcggcgccgggggcgctgttcatgccggttcccgacggctccgtggctgctgcggggctggggctggggctacccgccgcggactccccgggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaagtgctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcagagacttaggaatgccattagagctcatagcaggagtataagaactacgttcatggaaagcctcccagaggatatgaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaattaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacacgtaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaccacttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacaatatctttaatgctagccaaggagtcagggatttggacgtattttcatggacttccaaagcttttttcccccaggaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacaataaaaatgtttaacggttaaaaaaacaaaaacaaaaaacaaagaaaaacaacacaacaacaaacaccaaaaacgccaacaaacacaagaggggcggaccccccccacaaaccgacccacccgcgacggcgccacacgactcacgacagcgcccccggtctcacgacgtcaacacgagcgggcccccccacagacggggacggccaatctcagcaacccccggccacggcccgcggaaacacacc

SEQ ID NO: 357455 - DNA, 9635 bp, Homo sapiens
  misc_feature (9624)..(9624): n is a, c, g, or t
tcttggagcgttctcagtttctcaacagatcttcacttgctaggcagccagaagccggcggcagtggcggcaccgcctcctcctcacattcccggggtggcggggttagatgagcggccccagtcgcggcgccgggggcgctgttcatgccggttcccgacggctccgtggctgctgcggggctggggctggggctacccgccgcggactccccgggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaagtgctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcagagacttaggaatgccattagagctcatagcaggagtataagaactacgttcatggaaagcctcccagaggatatgaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaattaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacacgtaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaccacttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacaatatctttaatgctagccaaggagtcagggatttggacgtattttcatggacttccaaagcttttttcccccaggaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaagttttgactgttttacccactgcaggtgaccaactgagtgccatattgaattccattcagtcacgacccaatctcccagctccttccatctttgatcaagctgcaaaacctccctcttccctagtacacagcccatttgtgttcggacagcccctttccttccagcagcctcagcttcagagtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggttaggatgtatcttggtgaactcctctttgggttgaattttattggagttctctgggcttctggtacctggatgttggcatccttccccagatttgggaagttttcagttattatttcttaaaatatgcttcctggccttctttctcttctccttctggtatttttgttatgcaaaagtcagttttcttgaaagtaccccccaattcctatagactttcttcattctttctcatttatttatttataattctcttactataaaatttgaaatggtctctctttgaggtcacttattctttcttctgcttgattgagtctgctgttgaagccttctattgaattattctattaagcaactgtctttttcatttctatgtnttctatttggt

SEQ ID NO: 357456 - DNA, 1188 bp, Homo sapiens
tcttggagcgttctcagtttctcaacagatcttcacttgctaggcagccagaagccggcggcagtggcggcaccgcctcctcctcacattcccggggtggcggggttagatgagcggccccagtcgcggcgccgggggcgctgttcatgccggttcccgacggctccgtggctgctgcggggctggggctggggctacccgccgcggactccccgggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaaggtaagccactgagttctattaatatttagatgtgtaacctgcaggtgttctggctataatgcatatatacgcattgctaaaatactttgctttatgtaaaattgcacactaaaaataacacggcttatggggcaaaaatagatttggagccagaaaaggaaaactctgcaactttataacctaaggtgcctaacaaagtcaataattgataattccactggaaagcgcaggaagggagatcagtgggttggagtctgttataggggcaattaaaaaatgtacaaaagcagtagggtggaaatgctagtatagaggcattgagccatggcagatggaagtagagctctgagccagtgagccgagagtaaggtgggcacaagagaaagccaagagccctggaaagctgggaggtgctcctcacctgggatgcaggtatgcgtttttatttttcttgaaatagaactacaaagcctctcagctgtgtagtagcagggctgagagccttttcctttctgcctaagcttataattgtactcttgatattgtggtttcccttgattag

SEQ ID NO: 357457 - DNA, 1184 bp, Homo sapiens
tcttggagcgttctcagtttctcaacagatcttcacttgctaggcagccagaagccggcggcagtggcggcaccgcctcctcctcacattcccggggtggcggggttagatgagcggccccagtcgcggcgccgggggcgctgttcatgccggttcccgacggctccgtggctgctgcggggctggggctggggctacccgccgcggactccccgggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaagtgctccagtctgagccacctgaggtcctaggtaagagccaaggctcattcagtgaagcatttaaaagtgaatataattaataatagagtattgtacacttcaaaattgttaagagaatatttctaaagttctcactacagaaaatgttaagtacttgaggtgatagatgttaattagtccacattttattcatgaatcataacatcactttataccccataaatttatataattataaattgtcaatttgcagtttttaaaaaagtgaagagcttctcttatgaagcacacacaatagcctgtaatgcagtctttatttaattgtggtacggaaacagcaggggtataagttctagagtatttttttctgtgttccactgaagttatggtttaagagttgaagttcgtgcacacacatttctcaattagtatga

SEQ ID NO: 357458 - DNA, 244 bp, Homo sapiens
tgattcagtcacttaaaaatctaaaatgctgcattctgaaataacattttcatctttttcatttgttactactactgataatttattggctttttaagtgctaatttttcttgtagttatctccgacgaggtgaaagtcattggtggatgaagggctcaacccctacccagatctcagagatcatcattaaacttatcaaggatatggcagcagtaagttcccattcttctgttttggcagtga

SEQ ID NO: 357459 - DNA, 746 bp, Homo sapiens
tggttttaatggaaaatggagatgtctatacatttggttatgggcagcatgggcagctaggacatggagatgtcaactccaggtacttgctaacttttcatttgaagatccagagttattttttcttctgttttcttttccttcttttttctttcttttctctttttaagtatatatttctagaattaaaataatattataccactgctttgcaaagtgtggcccatgaattattggtggtttctgatcttatggttgagtgcttttgtagagataaaggattttgtagtttcaggagaaaagctgatatatattttaaataggagagtgattatgattgtcacaaaatatcactatattcttagcaattatctttttaaaggctgtgcatggcaatagaaaaatagtgaattgtatttttaaaaaatgtcagcaatggattcaaacatattcctgatgtctgttttgaaattttggtctaataacatgcagtcattgaagcttttgaataatttttggacagaacctattggtctctctgattaactcttttgacttattgcaaatagtagtagagagactggtggtaatttcctaatatccctacttcatttgttttagttttagttttagttcgtgacatgatcgtgcagctaaagattccctttctcagcttccattgcagcaggatgtggccatgtgaacttaagtgataggtgccactttggaatcttgctgttaaaggg

SEQ ID NO: 357460 - DNA, 340 bp, Homo sapiens
ttgttgttgtttttggccaatcatctagctgtcccagtgcccggggttaacattgaagaacaccttcagttacgacaagaagaaaaacggcaacgtgtaatcagaaggcacagattagaggaaggaagaggtaagatgtagctacagagaaaaagtacatgaaaatccactttcctaccctatcctgaaaccactgaaaagttcacacaataaactaatttggtaagaaatcatcaaaattaaaattagcaatattctgataactcatataatgggaaaatattcagggtattcatgcttcttctaataacatacgtttaggtatttataattgtgctaa

SEQ ID NO: 357461 - DNA, 14942 bp, Homo sapiens
tcttggagcgttctcagtttctcaacagatcttcacttgctaggcagccagaagccggcggcagtggcggcaccgcctcctcctcacattcccggggtggcggggttagatgagcggccccagtcgcggcgccgggggcgctgttcatgccggttcccgacggctccgtggctgctgcggggctggggctggggctacccgccgcggactccccgggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaagtgctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcagagacttaggaatgccattagagctcatagcaggagtataagaactacgttcatggaaagcctcccagaggatatgaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaattaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacacgtaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaccacttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacaatatctttaatgctagccaaggagtcagggatttggacgtattttcatggacttccaaagcttttttcccccaggaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtcta

SEQ ID NO: 357462 - DNA, 14769 bp, Homo sapiens
tcttggagcgttctcagtttctcaacagatcttcacttgctaggcagccagaagccggcggcagtggcggcaccgcctcctcctcacattcccggggtggcggggttagatgagcggccccagtcgcggcgccgggggcgctgttcatgccggttcccgacggctccgtggctgctgcggggctggggctggggctacccgccgcggactccccgggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaagtgctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcagagacttaggaatgccattagagctcatagcaggagtataagaactacgttcatggaaagcctcccagaggatatgaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaattaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacacgtaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaccacttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacaatatctttaatgctagccaaggagtcagggatttggacgtattttcatggacttccaaagcttttttcccccaggaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtcta

SEQ ID NO: 357463 - DNA, 8962 bp, Homo sapiens
actagtccacggcttggtggtttcccggcagaccttctccaagcctgcagattcgagaaaccagcctggacaccaagtctgtgtcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacaatatctttaatgctagccaaggagtcagggatttggacgtattttcatggacttccaaagcttttttcccccaggaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtcta

SEQ ID NO: 357464 - DNA, 7723 bp, Homo sapiens
tattgtttttcgcctcactccagcatgagaaagaaaagagaggctggccgcatcagtttttatttttatttttgtacttcaaaaagtgataagttcacgtaaactacatgccattattattcataatgataattgcattttctatacaatcgatatcatttccatttttattataaaacagcagactggtttctgtcataaaacaaatctggcttgtattagaacaaatacatcctcatttaaagaattttaaggtttctttcttgcattgagtatcttaagctttataacaacgtctggctcttaattttagtaaatggcatgacacactatatccatggagagcttctgacaaaaacttacttatcagacagaatttcttcggtgtgttgtttactcagatggcttcagtttctctttagtaaaataatatttccatgttggtgctagagtacagaaaaatgttgttactgtgcacgcatcttctgcagatgatatcctgttccctttctttgttgatatttttctttcttaaactttgttgctcagaatatctttaatgctagccaaggagtcagggatttggacgtattttcatggacttccaaagcttttttcccccaggaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtcta

SEQ ID NO: 357465 - DNA, 15167 bp, Homo sapiens
tcttggagcgttctcagtttctcaacagatcttcacttgctaggcagccagaagccggcggcagtggcggcaccgcctcctcctcacattcccggggtggcggggttagatgagcggccccagtcgcggcgccgggggcgctgttcatgccggttcccgacggctccgtggctgctgcggggctggggctggggctacccgccgcggactccccgggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaagtgctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcagagacttaggaatgccattagagctcatagcaggagtataagaactacgttcatggaaagcctcccagaggatatgaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaattaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacacgtaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaccacttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacaatatctttaatgctagccaaggagtcagggatttggacgtattttcatggacttccaaagcttttttcccccaggaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtctaaaaaaacaaaaacaaaaaacaaagaaaaacaacacaacaacaaacaccaaaaacgccaacaaacacaagaggggcggaccccccccacaaaccgacccacccgcgacggcgccacacgactcacgacagcgcccccggtctcacgacgtcaacacgagcgggcccccccacagacggggacggccaatctcagcaacccccggccacggcccgcggaaacacacc

SEQ ID NO: 357466 - DNA, 14006 bp, Homo sapiens
tcttggagcgttctcagtttctcaacagatcttcacttgctaggcagccagaagccggcggcagtggcggcaccgcctcctcctcacattcccggggtggcggggttagatgagcggccccagtcgcggcgccgggggcgctgttcatgccggttcccgacggctccgtggctgctgcggggctggggctggggctacccgccgcggactccccgggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaagtgctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcagagacttaggaatgccattagagctcatagcaggagtataagaactacgttcatggaaagcctcccagaggatatgaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaattaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacacgtaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaccacttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacaatatctttaatgctagccaaggagtcagggatttggacgtattttcatggacttccaaagcttttttcccccaggaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttccgagtcttctacggggtcaacgacgtcccgtaccgagccagcactcccttcacgatcgacatctagcggactcctccttcccggac

SEQ ID NO: 357467 - DNA, 13624 bp, Homo sapiens
tcttggagcgttctcagtttctcaacagatcttcacttgctaggcagccagaagccggcggcagtggcggcaccgcctcctcctcacattcccggggtggcggggttagatgagcggccccagtcgcggcgccgggggcgctgttcatgccggttcccgacggctccgtggctgctgcggggctggggctggggctacccgccgcggactccccgggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaagtgctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcagagacttaggaatgccattagagctcatagcaggagtataagaactacgttcatggaaagcctcccagaggatatgaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaattaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacacgtaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaccacttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacaatatctttaatgctagccaaggagtcagggatttggacgtattttcatggacttccaaagcttttttcccccaggaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggatcgtagtcacatagtcgcacattacagtgctgtccggccgagtacatagcaaagcgagggcgctggaccaaggataacacgtcggcgacggaccgagctcagattc

SEQ ID NO: 357468 - DNA, 1549 bp, Homo sapiens
cgactctagagatccccctcgcgaacgtgttatccttgtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtcta

SEQ ID NO: 357469 - DNA, 8469 bp, Homo sapiens
tcttggagcgttctcagtttctcaacagatcttcacttgctaggcagccagaagccggcggcagtggcggcaccgcctcctcctcacattcccggggtggcggggttagatgagcggccccagtcgcggcgccgggggcgctgttcatgccggttcccgacggctccgtggctgctgcggggctggggctggggctacccgccgcggactccccgggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaagtgctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcagagacttaggaatgccattagagctcatagcaggagtataagaactacgttcatggaaagcctcccagaggatatgaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaattaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacacgtaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaccacttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacaatatctttaatgctagccaaggagtcagggatttggacgtattttcatggacttccaaagcttttttcccccaggaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtaggtatttaaaagtaagtcttttacttacctaacttcaatattttttattaccttctcttttatacactttttatttgtgttcacccagaaatctttattaaattaaaatttgttcatggaaagctaataaaaaatgtttaca

SEQ ID NO: 357470 - DNA, 255 bp, Homo sapiens
tctcattttatttttcttaccaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtacca

SEQ ID NO: 357471 - DNA, 580 bp, Homo sapiens
aagtataggtggctcagcctaagcatccaatttattaggctatttaaatgatatattcacagtatacagaacagggattgttaaagtaccattcaaaagaagtcctccttggcttaacacatcgactttaatttaaccaggtaggaaactcacttcttttctttttctagctatgtttttgctcaccgaagctaaatatacatatgaattgattccacagccatggaattgagaaaaaccaggaagtgatgctgaaaacataaatgaaactatgatccacgatctgttgctctaaacgccgtttcttccggagaaccttaaagataaatatgcaaccctttacattctccagtgatgtcaacagcctaagctgaatttcaaattacatcgagtcaatgaaaaggtgaatggatttttagagcaactcagattcaaagaatcaaatcgcctttattcttattttaaggaacatgactgataacctgtgcagaaaataaaaaaaaaactaactatagcaatcgcagcatatgtttaacctaacaattaaaaatatataactgaaaattacaataaaaagcga

SEQ ID NO: 357472 - DNA, 666 bp, Homo sapiens
aagtataggtggctcagcctaagcatccaatttattaggctatttaaatgatatattcacagtatacagaacagggattgttaaagtaccattcaaaagaagtcctccttggcttaacacatcgactttaatttaaccaggtaggaaactcacttcttttctttttctagctatgtttttgctcaccgaagctaaatatacatatgaattgattccacagccatggaattgagaaaaaccaggaagtgatgctgaaaacataaatgaaactatggtattatttagaaaaaaactttcaaggaatcagttattttaccaattccaaaagaatgaaaaaagtgaagactcagaaaacgtcagatccacgatctgttgctctaaacgccgtttcttccggagaaccttaaagataaatatgcaaccctttacattctccagtgatgtcaacagcctaagctgaatttcaaattacatcgagtcaatgaaaaggtgaatggatttttagagcaactcagattcaaagaatcaaatcgcctttattcttattttaaggaacatgactgataacctgtgcagaaaataaaaaaaaaactaactatagcaatcgcagcatatgtttaacctaacaattaaaaatatataactgaaaattacaataaaaagcga

SEQ ID NO: 357473 - DNA, 442 bp, Homo sapiens
ggggacacgcctcactttgagacaacttgaggctgcgtcagtgaccttgtactgttgttatacaattcaatattgaagcgagagattctccagaacttgcccagaagccaagacgtctggaaaggatctcagcctctgtcagcctgcagcttgggaagagtgattcacagagcctgactgtccactgctgctaaaccatacactggccttggctcacacatctgactgaactgtctcctatgactaactgcctctctttcttcagccttgcaagtttcctgggagtcctgggagtgggacttcacatataaaaggggactctggggagacctagttcctgggcttctcttctgggaagtcaggggaagagtatagggaaggagtgggccacagtgcccaacttgacaatttgacaattttcaccaagtaagtcctttttggg

SEQ ID NO: 357474 - DNA, 722 bp, Homo sapiens
aaataagaatgcaaaagagtgagagaaatcctacaaaacttaagttacatcaataggcacacaaatagtaatcttatgggaattccagaaggtgaagagaaggaaaattacatagaaaatctggttaatgaaatagtagatgaacactttccatgtcggtggagagagatggacgtttcaattcaggaatctcaaaggtctccaaagagaatcaactgcaaatggtcctccccaaggcatattgcaattaaatggtcaaatggcagagacaggaaaaaaatttaaaaacagcaagagaatgaggagaaaaagcaaaaaagaacagcaaaacagtcaagtcacatacaaaggaatcccaattagaataacagatttcttgcagaaaccttacaggctatgaatgagtgggatgatgtattcaaagtgctgaaagaaaaaataattgttttacatgatacgaccgagaatactgtaactgtaaaaaccaaagaatactataaccaccaaagctgtagttcagcagagagagagagaaataatgtctttcctagaaaaaaatctgagagaatttataactgctagatcagccttacaagaaatagtcaaggtagtccgagatctagcaggccacaggacaatattcaccatcatgaaaacatgagaaagataatagaacagatattaaaagaaaacagagacaagaattaaaccttgtcgctgca

SEQ ID NO: 357475 - DNA, 1142 bp, Homo sapiens
ggccccgccctactccgcgtggattggttgaccgcccttcgagcccggtgctgactggcttgcgtctctgccactttctttcagcttagtggcgcgcggcgcggcgacgaccgccgggagcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaagctggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactaca

SEQ ID NO: 357476 - DNA, 706 bp, Homo sapiens
  misc_feature (29)..(29): n is a, c, g, or t
  misc_feature (673)..(673): n is a, c, g, or t
  misc_feature (706)..(706): n is a, c, g, or t
ggacgcgtgggtcggacgcgtgggtcganccacgcgtcgaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctgtccaagctggttgattctagaaagtctgtgtgaagcatctttcaggcctngctttggtttaaggcagcactttcaggcgggtn

SEQ ID NO: 357477 - DNA, 413 bp, Homo sapiens
ggccccgccctactccgcgtggattggttgaccgcccttcgagcccggtgctgactggcttgcgtctctgccactttctttcagcttagtggcgcgcggcgcggcgacgaccgccgggagcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggtgggtgctgcacccaccaacgggggtgggatgcagggggtgcacactcagcctcctccctccctccctgggcctcatgggaggagtcagtgggg

SEQ ID NO: 357478 - DNA, 1841 bp, Homo sapiens
ggccccgccctactccgcgtggattggttgaccgcccttcgagcccggtgctgactggcttgcgtctctgccactttctttcagcttagtggcgcgcggcgcggcgacgaccgccgggagcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaagctggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactacacactgcacatccactgttccttttgagcttctgggtgcacctagcgggtctcctgccctctgtccatcgctggactctcaggaaatccccgttcccgtaagggaagcttccttttgagagttctcaccaggtgtcagcggcacagtgaggcactgatgtccttttacaaaaggcaagaccagcatctggacagtgggggctcttgagagtccccggcgccccccacaccaggttgtcctataaccctccccctctgtggaaacgttaatgccaaggggtgtgtggggaagggaaagtcccaggcaggggccacgcatggtcccccatcaccccctcctgggtggcctggactccatcatctatcctcatctgtccacactggcgttcacacagagaagacaggacaggaatcccctcggaagatgctcatggaagattctcacgaggctcctgccccctttctgagccaggccgggtttgccactcctcgggcgcgcacctgagacactgagtcagcgctttcgagaaaggctccgggtagcatctgtggaccgtgaagaaaccagagggaagccctgagccaggcagcggcccgtccccctgcatagccttctcttcagggtcctcgttcggagacctattttgagaggtgattggaataaaaggtcccgtccgtgaggaactctttaaattgagtct

SEQ ID NO: 357479 - DNA, 1812 bp, Homo sapiens
  misc_feature (1654)..(1654): n is a, c, g, or t
  misc_feature (1812)..(1812): n is a, c, g, or t
ggccccgccctactccgcgtggattggttgaccgcccttcgagcccggtgctgactggcttgcgtctctgccactttctttcagcttagtggcgcgcggcgcggcgacgaccgccgggagcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaagctggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactacaaaaaaaaaaaaaaaaaaaaaaaaaaaaaaaaaaaaaaaaaaaaaaaaaaaaaaaaaaaaaagggggggggggaaaaaaacccccgggggggcgccatggggcccccgtttttggaaagggggccccaagggggaggcgataaataaagagcaagaggcggcgggggcccggggataaacaacaggcgcgccggagggggggaagaacagcgtggtgctcccgcggggaatgctgtggcgggagagagaaccccccccactgtcggggggggggcgccccacctgtgtcgggcaccaccaccccccccgcagaggaggtattttaacgcgctcccaggggaacaatacacacccttggaggcgctctagcggcggtgcaccacccacaggcggttatatatgcgtggcgggggggggaaaaaaaaattatccggcgcccgcggcgggatctatgttctccgcgcgagacaatttttcttccgccggacgtcggtgtgttaaggaatattccangtacgtctggcgtccacctaacaccaccagcacacaccacacacaccgacaccaccgacgagttgaccatcgatgccgactcgtcgacatcaagcggatcgacaggcatccacgatgacacagccgcaaccatcacacacaccaccacagatcacccn

SEQ ID NO: 357480 - DNA, 1085 bp, Homo sapiens
cggcgaccccaaggctgtctgcgagggcagcgcttgtcccgccgccgtcacccgcacaggcacagactctgccacagcccgccgccgcacgtgccgccgccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaagctggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactaca

SEQ ID NO: 357481 - DNA, 1010 bp, Homo sapiens
  misc_feature (29)..(29): n is a, c, g, or t
ggacgcgtgggtcggacgcgtgggtcganccacgcgtcgaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaagctggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactaca

SEQ ID NO: 357482 - DNA, 1247 bp, Homo sapiens
ggccccgccctactccgcgtggattggttgaccgcccttcgagcccggtgctgactggcttgcgtctctgccactttctttcagcttagtggcgcgcggcgcggcgacgaccgccgggagcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggtgaagaaccccaaccagagagagccccatcccaggctggagggagccccagtcagccactcctgagccaggcccacgggcagaggataggagccagtcttccttgacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaagctggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactaca

SEQ ID NO: 357483 - DNA, 965 bp, Homo sapiens
ggaagtgcggagccctcccgacatgctcctgtcactgctgaacggcaaatccccatgtggtggagctgaaatggggagacgtacaaggacatgtgagctgcgaactggatgaactactgagaagttctgcgcaggacgacggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaagctggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactaca

SEQ ID NO: 357484 - DNA, 449 bp, Homo sapiens
catcccaggctggagggagccccagtcagccactcctgagccaggcccacgggcagaggataggagccagtcttccttgtgagtgcacaatgggggctgcgcctaccacacccacccttgctcctgggtgaaggattgcctggggtcaggacagatcctgcctgcagggtggaccctttgccacgtatgtcccgggactgatactgtgcagcttgcaggggtggtacggggtgcaggctgggcaggatctgcagggcctcccgcgctcccagggctgggccagacggcccggtggtaagttaataacctgctccccttctccgcagggacggggacaagttctggcggatgcccgagtgctacatccgcggcagcaccatcaagtacctgcgcatccccgacgagatcatcgacatggtcaaggaggaggtggtggccaagggccgcgg

SEQ ID NO: 357485 - DNA, 520 bp, Homo sapiens
  misc_feature (503)..(503): n is a, c, g, or t
ggccccgccctactccgcgtggattggttgaccgcccttcgagcccggtgctgactggcttgcgtctctgccactttctttcagcttagtggcgcgcggcgcggcgacgaccgccgggagcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcgggaccccgtgaggccctggcaagtaagctcgagtccggctctggccccgttggttgggccggcncctttggccccgggtgg

SEQ ID NO: 357486 - DNA, 1225 bp, Homo sapiens
ggccccgccctactccgcgtggattggttgaccgcccttcgagcccggtgctgactggcttgcgtctctgccactttctttcagcttagtggcgcgcggcgcggcgacgaccgccgggagcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaagctggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagccaggccgggtttgccactcctcgggcgcgcacctgagacactgagtcagcgctttcgagaaaggctccgggtagcatctgtggaccgtgaagaaaccagagggaagccctgagccaggcagcggcccgtccccctgcatagccttctcttcagggtcctcgttcggagacctattttgagaggtgattggaataaaaggtcccgtccgtgaggaactctttaaattgagtct

SEQ ID NO: 357487 - DNA, 1115 bp, Homo sapiens
cggcacgaggtggatcacttaatgtatgggatgtatttcagtcacggctgttattaaaatgttttattcagacagctttattgaggtataatcgacttacaataaatgtcacatgtctaaagtgtacaatgtgaaaaatttgacatatgtatacgtccatgaaaccatcatcacagccaagatcatggatatctacaccacaccccaaagcttgctcctccctgtcctttccgctctccctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaagctggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactaca

SEQ ID NO: 357488 - DNA, 916 bp, Homo sapiens
ttacgggggctatgtgcatactgatggcccctcggtgttatcggacgaggactggataacattaatctgcgagaagtatctgcacgtcagtggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaagctggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactaca

SEQ ID NO: 357489 - DNA, 1002 bp, Homo sapiens
ggaggagtagctgggcttcggctgtgtctggtgcacagggaggcccccacccgctctgggctttgggctgcaggtgaagaaccccaaccagagagagccccatcccaggctggagggagccccagtcagccactcctgagccaggcccacgggcagaggataggagccagtcttccttgacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaagctggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactaca

SEQ ID NO: 357490 - DNA, 1744 bp, Homo sapiens
  misc_feature (1264)..(1264): n is a, c, g, or t
  misc_feature (1347)..(1347): n is a, c, g, or t
  misc_feature (1356)..(1356): n is a, c, g, or t
  misc_feature (1442)..(1442): n is a, c, g, or t
  misc_feature (1518)..(1518): n is a, c, g, or t
  misc_feature (1533)..(1533): n is a, c, g, or t
  misc_feature (1563)..(1563): n is a, c, g, or t
  misc_feature (1574)..(1574): n is a, c, g, or t
  misc_feature (1603)..(1603): n is a, c, g, or t
  misc_feature (1607)..(1607): n is a, c, g, or t
  misc_feature (1619)..(1619): n is a, c, g, or t
  misc_feature (1698)..(1698): n is a, c, g, or t
gcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtatttttccctctccaccctggtcttctcctgtaacgtgtggccgccttttccagcacggcctcctgccttcctggtgcactttttggagaacgtggtggaatcagaggtttctggctgactcggtgggtgctttgaaccaggaaaggacaagaaagaggttggagtacagtggcatgatctcagctcactgcagcctcgacttcctgggctcaagaaatcctcctgtctctgccttccgagtagctgtgatcacagttgtatgccatcatgcccagaccagatttcgccatattgctcaggatggtcttgaactcctgggctcaagtgatccgcctgccttggcctcccagaatgccaggattacagatgtgagccactgtgcctggcctgaagtctagtaatttttaaaactttgcatgttattctgctcatgagccaagttcgggtgcctgtggaacagctatattcctcaaactagatatgcaccccagtccctggggattctgtcaaaaggcagattcacattcagcaggtctagggtggggggcctgacattcggcacgtctcacaagctcccaggcgatgctgatggtgctggtccctggacgcccncttgagtagtaaggaacaaaaggactctcccctgttcttttcagctacgtagcccagtggttctccacttaggcttcacactngaatcatcnagggagttttaaactatagtgatgcctggcggtgtcttactcgcagagcttctggtttgattggtctaggttgcagcctgggcaangagatttaaaaacttctcagatgggccaggcatggtggctcaagcctgtaatcccagcactttgggaggcagaggngggcggatcacgagntcaggagatcgagaccatcctggctagcanggcgaaacccngtctctactaaaaatacaaaaaattagcngggngtggtggcgtgngcctgtggtcccagctgctcgggaggctgaggcagaagaatggcctgaacccgggaggcggagcttgcagacagccgancgtgccactgcactccagcctgggcgacagagcgagactccgtctc

SEQ ID NO: 357491 - DNA, 734 bp, Homo sapiens
gcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtaagtttccctgcggttcggggaagggatctgatttactttcttttctttctttccttttttcctccgcgtcgtttttcgaagg

SEQ ID NO: 357492 - DNA, 435 bp, Homo sapiens
  misc_feature (35)..(35): n is a, c, g, or t
gcaagaaggggtccttgcatagtgcagggaagagnaaagttttgtctgcaacgactctcttaatttccaccgctacacacccatgcaggagacctctccaggtacacatatttcctgctactgaatggcttagactgggatttgcaaggaactacgaagtccaagacctttgcctttcttttagaagaaggcaccagctggttctccaatgttgaaggtcttctccagagatgaactctgaaagccacatgttgagatggccccattacaggatggagagcacctgaacccccaagttatggactagaagaagacagttgccctggaaaatcatctgacccacattggactttatgtgagggggaaataaacctttattatgttaagctacacaataataaataacaacaataattgtgtttatttgttacctca

SEQ ID NO: 357493 - DNA, 661 bp, Homo sapiens
agcattctcagggccttctgccaagggcccgctttgatctcccttaaaggacagcattatctgaccagagacccatgcaggagacctctccaggtacacatatttcctgctactgaatggcttagactgggatttgcaaggaactacgaagtccaagacctttgcctttcttttagaagaaggcaccagctggttctccaatgttgaaggtcttctccagagatgggcatgcagaaggagtgaaaaaacaagaaggaagacaaggaagacattgttttggctgctgacatttcctgaaagatctgaggcgtccccttcacttcgggcatgggacccagacggctgagtgatggaccttaaggtgtggggagattacaacttgctcaaggtctcatagctagaagatgtcagagtgataactcaaaccatgtcacatgactctaagcccaaagcagcctctagaaggttgtttgatcttctgatggaagcacaaatcaccattccaacatgaaagatggagaaacttaagtctagagagatttaaaggacttgtcaaaggcaatgaaacaagtgatgaggaaactgaggcccagagaggataaatgacttgctcaaggttagccagttggtcaatggcaaagattaaaccagaacccagatc

SEQ ID NO: 357494 - DNA, 531 bp, Homo sapiens
gtccctgcagcgggctccatctccaggcctcccacttcaccctgggacattatggtcgctggtcagacctcatgactcacttggactcttgagccacctctgggggtggagtctctctcctggcatctggacccttggtgctatcgacgaagcttggctggcgctcttagctgctatgtgcaagacgtgtgtcccagggaaagcccctctctctctgcagaggtcaagtgaaagccacggccgcagccaacagagttcaaaatgcaggcttggaaagtccagggggctctgtggaggagattagtcctgagagactgacaccagagccacctgacgaatgtgggtgctcagagccttggactcgatgacctacctctcctgcctcccacctgactcctgaagtaggggagtgtattaacagtcacaggcctcagtttacctgctttcagcctctgcccttcccgagagggttgaagctgacttgctgcatcgcagttttgtcctttagttcatcagctctggaactttcca

SEQ ID NO: 357495 - DNA, 2317 bp, Homo sapiens
gcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtatttttccctctccaccctggtcttctcctgtaacgtgtggccgccttttccagcacggcctcctgccttcctggtgcactttttggagaacgtggtggaatcagaggtttctggctgactcggtgggtgctttgaaccaggaaaggacaagaaagaggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgcaatgattgaatga

SEQ ID NO: 357496 - DNA, 2309 bp, Homo sapiens
tatatagactcatgtataaatagatacttgtaatatacgagcatctgctctgtggaagatgtttttttccaggcccagaagtgtaagatccggtgcctatcttcaggcgggtggcaaacaaacatcacataaaggagagtgtctggcttgtgtcttctgggttcgtgatccccctgacttcagtgtgagaatgtggccagagcgtctggggaagacagggagagttgtcagagaggagttttgaggaggccctgaaggctcgccggctgttaaggcctgagctgtagtgggcaagaagagatggccagttcaggtagaggaagcctgctttgagctgaagaccggaggtgaatctggacagggcttcccaggaccagtatttttccctctccaccctggtcttctcctgtaacgtgtggccgccttttccagcacggcctcctgccttcctggtgcactttttggagaacgtggtggaatcagaggtttctggctgactcggtgggtgctttgaaccaggaaaggacaagaaagaggtgccacctcctgagtcctggttcctgcggctccgtcgaatctgcagtgaaggcctttgggaagcgtgggttatgtgggtccaggggtcccatcctcccgtggaggcccttgacctgaggatcactaactcacaccccaccgacttccggcccccaacaagggcagtgttcctcttgctccattctgctctgaagtcccccaaaccgcttcctggggctgcttagtgaaatacaaggctcatctctgaggacctctacagggctggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgcaatgattgaatga

SEQ ID NO: 357497 - DNA, 1804 bp, Homo sapiens
gtccctgcagcgggctccatctccaggcctcccacttcaccctgggacattatggtcgctggtcagacctcatgactcacttggactcttgagccacctctgggggtggagtctctctcctggcatctggacccttggtgctatcgacgaagcttggctggcgctcttagctgctatgtgcaagacgtgtgtcccagggaaagcccctctctctctgcagaggtcaagtgaaagccacggccgcagccaacagagttcaaaatgcaggcttggaaagtccagggggctctgtggaggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgcaatgattgaatga

SEQ ID NO: 357498 - DNA, 1826 bp, Homo sapiens
gaccccaaatgcagaggagccccttgaactcttagttgctggtggctccccaggtgccacctcctgagtcctggttcctgcggctccgtcgaatctgcagtgaaggcctttgggaagcgtgggttatgtgggtccaggggtcccatcctcccgtggaggcccttgacctgaggatcactaactcacaccccaccgacttccggcccccaacaagggcagtgttcctcttgctccattctgctctgaagtcccccaaaccgcttcctggggctgcttagtgaaatacaaggctcatctctgaggacctctacagggctggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgcaatgattgaatga

SEQ ID NO: 357499 - DNA, 1073 bp, Homo sapiens
gcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtatttttccctctccaccctggtcttctcctgtaacgtgtggccgccttttccagcacggcctcctgccttcctggtgcactttttggagaacgtggtggaatcagaggtttctggctgactcggtgggtgctttgaaccaggaaaggacaagaaagaggtgagttgcacttggcagttatagtacagctgcctgcctgtggctcttcttgctttgaggtttgctccttcttcagtgcaaccctttgcccagacatccctaatgcccccagctcagagcagcagttggcaggcaggagctttgcagttagccatcggagagccccacagacaggggttaataagtacaaacagtcatcacaattaattcaggccaggctgtgtgctcctggcttttagttgaatcaactcattttcacctctc

SEQ ID NO: 357500 - DNA, 655 bp, Homo sapiens
  misc_feature (35)..(35): n is a, c, g, or t
gcaagaaggggtccttgcatagtgcagggaagagnaaagttttgtctgcaacgactctcttaatttccaccgctacacacccatgcaggagacctctccaggtacacatatttcctgctactgaatggcttagactgggatttgcaaggaactacgaagtccaagacctttgcctttcttttagaagaaggcaccagctggttctccaatgttgaaggtcttctccagagataccttaaggtgtggggagattacaacttgctcaaggtctcatagctagaagatgtcagagtgataactcaaaccatgtcacatgactctaagcccaaagcagcctctagaaggttgtttgatcttctgatggaagcacaaatcaccattccaacatgaaagatggagaaacttaagtctagagagatttaaaggacttgtcaaaggcaatgaaacaagtggaactctgaaagccacatgttgagatggccccattacaggatggagagcacctgaacccccaagttatggactagaagaagacagttgccctggaaaatcatctgacccacattggactttatgtgagggggaaataaacctttattatgttaagctacacaataataaataacaacaataattgtgtttatttgttacctca

SEQ ID NO: 357501 - DNA, 550 bp, Homo sapiens
tggcatctggacccttggtgctatcgacgaagcttggctggcgctcttagctgctatgtgcaagacgtgtgtcccagggaaagcccctctctctctgcagaggtcaagtgaaagccacggccgcagccaacagagttcaaaatgcaggcttggaaagtccagggggctctgtggaggtgagacagccacaggctgagctttctgagcccttggggtgagtttggctgtgatacctgagagatgggggaactaacaagcgccgggttgcagtgtcgtcccatgcagaggagcgagcagagttcacccaaaaggccaacggctggcagggtgtcacgtttcccaccacacccggggctcagcctctgctgtcatttctcctccttggttttcatcttctaagggaagaaatagtgtcatcttttctcaacctgtcagtctcacacctgcctggagcccctggcagtgagacacccagtgctgtttaatctgatgtcatctctgttgattgtctgttttagaaaccaggtagcaagagggactttctgaggat

SEQ ID NO: 357502 - DNA, 915 bp, Homo sapiens
gcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtggaatcagaggtttctggctgactcggtgggtgctttgaaccaggaaaggacaagaaagaggaactctgaaagccacatgttgagatggccccattacaggatggagagcacctgaacccccaagttatggactagaagaagacagttgccctggaaaatcatctgacccacattggactttatgtgagggggaaataaacctttattatgttaagctacacaataataaataacaacaataattgtgtttatttgttacctca

SEQ ID NO: 357503 - DNA, 482 bp, Homo sapiens
  misc_feature (18)..(18): n is a, c, g, or t
cactcctgttctagcacncagttcaagtgcaacagcgggcgttgcatccccgagcactggacctgcgatggggacaatgactgcggagactacagtgatgagaagagctgtgagggagtgacccacgtctgcgatcccagtgtcaagtttggctgcaaggactcagctcggtgcatcagcaaagcgtgggtgtgtgatggctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgcaatgattgaatga

SEQ ID NO: 357504 - DNA, 2582 bp, Homo sapiens
gcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtatttttccctctccaccctggtcttctcctgtaacgtgtggccgccttttccagcacggcctcctgccttcctggtgcactttttggagaacgtggtggaatcagaggtttctggctgactcggtgggtgctttgaaccaggaaaggacaagaaagaggtgccacctcctgagtcctggttcctgcggctccgtcgaatctgcagtgaaggcctttgggaagcgtgggttatgtgggtccaggggtcccatcctcccgtggaggcccttgacctgaggatcactaactcacaccccaccgacttccggcccccaacaagggcagtgttcctcttgctccattctgctctgaagtcccccaaaccgcttcctggggctgcttagtgaaatacaaggctcatctctgaggacctctacagggctggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgcaatgattgaatga

SEQ ID NO: 357505 - DNA, 2220 bp, Homo sapiens
gcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtggaatcagaggtttctggctgactcggtgggtgctttgaaccaggaaaggacaagaaagaggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgcaatgattgaatga

SEQ ID NO: 357506 - DNA, 1713 bp, Homo sapiens
gcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtatttttccctctccaccctggtcttctcctgtaacgtgtggccgccttttccagcacggcctcctgccttcctggtgcactttttggagaacgtggtggaatcagaggtttctggctgactcggtgggtgctttgaaccaggaaaggacaagaaagaggttggagtacagtggcatgatctcagctcactgcagcctcgacttcctgggctcaagaaatcctcctgtctctgccttccgagtagctgtgatcacagttgtatgccatcatgcccagaccagatttcgccatattgctcaggatggtcttgaactcctgggctcaagtgatccgcctgccttggcctcccagaatgccaggattacagataaacagcttgatggattgctgaggcagagtgcaccgagcaagggttcagtcctccatagagctcagagcaaaaggaatgacccagccgggatgaacttgaacctatggccacctagctctggtttctgcttggacattttatttcaatcttatggcctgccttgcgctccaagggttacttatttcctctgcacatattttattttgatgccaaaatttcagatctgttttcttaagagcagaaggtcttgacctcaaagcccgggccatcacacagctctctgtggagtggggtgagggaggccagctgccggtcaccttctgctccagcaccgtgggaggcctgagtggcaaagctccagccccgctgctcccgggcggtgtccgcaacaagaggcttccgccccatcccaccagccatccacggagacgccctccccagaggtcaggagggtagcgggggaaggaaatgccaatcaatccatcaaagccccgccctcccggggctcctaggccccgggagctgcgtctgcgcatccttgacccactcctgggggccaggagctgggcgagccggggaagtgcatttggtaatgattctcgatttcctgtttggtttctgtccagggggctttgggataggctaactcgtattatatgtgtacacatgcacatttcattcctccttgtctg

SEQ ID NO: 357507 - DNA, 1012 bp, Homo sapiens
gcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtatttttccctctccaccctggtcttctcctgtaacgtgtggccgccttttccagcacggcctcctgccttcctggtgcactttttggagaacgtggtggaatcagaggtttctggctgactcggtgggtgctttgaaccaggaaaggacaagaaagaggaactctgaaagccacatgttgagatggccccattacaggatggagagcacctgaacccccaagttatggactagaagaagacagttgccctggaaaatcatctgacccacattggactttatgtgagggggaaataaacctttattatgttaagctacacaataataaataacaacaataattgtgtttatttgttacctca

SEQ ID NO: 357508 - DNA, 896 bp, Homo sapiens
gcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtatttttccctctccaccctggtcttctcctgtaacgtgtggccgccttttccagcacggcctcctgccttcctggtgcactttttggagaacgtggtggaatcagaggtttctggctgactcggtgggtgctttgaaccaggaaaggacaagaaagagaagatcaggttcaagttgccagccagactctgggcttccaggaggagtgggctgtggatggcctggcctcatttgcatgtccctctc

SEQ ID NO: 357509 - DNA, 815 bp, Homo sapiens
gctgctcagggctgggctgtttgctgcccagaaccaaggctaggatgaggagctcagactcttccagtggaagcagtgctaggacggaagacagccgcccctgaagaggggacattgacatacagttgatctgcctgggaaggtgtaatagagatgaacttgtgtcatcgcatctttcacacaagccacaaagaaagctaatcctgattcctggtgagaagaaaccaaactcgaggaatgttttatatcacaggacggtcacagcctgtactggggcacgagccagggctgagtagagtgctgcccctgcactcactgacttgatcctctcatttactctgtggagcagtccctgttgggatcctgctgctttgggaaattgctctgttaagcttgcagagctatgaaattgtggccctatttcaaacccatgagggcctgattctacagactgaccactgggctcttttacttcagcaggacttgggctggggctgcagggatttcaccaaggaatgtcaggcaggaggtggccattgtgaaacctgtcccatcttgcctgtacctcctggctgaaagtgggatgcaggacttagattgccaagcttaggaattatttgtggctctgctgttcacaattttggagaatgttaaggaatactcaagaagttgtgagagtaagggccctcacatatatcagaacatgaaagcattccagttaggaccttgtgatattgaaactagaataagcaacccagtggatagactgtgaaagagaatccacatatagacctatgtgtaagaatttatgatca

SEQ ID NO: 357510 - DNA, 2547 bp, Homo sapiens
ggccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctgcacctccctccccgcgccccgtcctctcccgccctacaggccctagcagggcaggcgggaggtgagcgcggccatcccgctcccggagttccgggatcctggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357511 - DNA, 1936 bp, Homo sapiens
tgctggtactggtcccgaattcttaagatggcaggcgggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357512 - DNA, 2240 bp, Homo sapiens
ggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggttgggcagtgaaggaactgaaatgaaccagacacactgattggaactgtattatattaaaatactaaaaaaaacaggccctagcagggcaggcgggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357513 - DNA, 2670 bp, Homo sapiens
ggccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctgcacctccctccccgcgccccgtcctctcccgccctacaggccctagcagggcaggcgggaggtgagcgcggccatcccgctcccggagttccgggatcctggaggtgggggctgtgccctgagggagggcacagggaaccgggatggggctgggggacagcgagtgctgggaagtgtgcgagatttcactccggggctcgggtcgagctaccccgtgcttcaggcggtcctgcgcctcctctccccaagacccttcggggacacagcactgcagacccgccggagacaacttgtgcgggagcccggagtcctcggaataacacttggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357514 - DNA, 2723 bp, Homo sapiens
ggccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctgcacctccctccccgcgccccgtcctctcccgccctacaggccctagcagggcaggcgggaggtgagcgcggccatcccgctcccggagttccgggatcctggaggtgggggctgtgccctgagggagggcacagggaaccgggatggggctgggggacagcgagtgctgggaagtgtgcgagatttcactccggggctcgggtcgagctaccccgtgcttcaggcggtcctgcgcctcctctccccaagacccttcggggacacagcactgcagacccgccggagacaacttgtgcgggagcccggagtcctcggaataacacttggtaagtgttaccgcgcccttcttcccttacgccagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357515 - DNA, 2352 bp, Homo sapiens
ggccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctgcacctccctccccgcgccccgtcctctcccgccctacaggccctagcagggcaggcgggaggtgagcgcggccatcccgctcccggagttccgggatcctggaggtgggggctgtgccctgagggagggcacagggaaccgggatggggctgggggacagcgagtgctgggaagtgtgcgagatttcactccggggctcgggtcgagctaccccgtgcttcaggcggtcctgcgcctcctctccccaagacccttcggggacacagcactgcagacccgccggagacaacttgtgcgggagcccggagtcctcggaataacacttggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357516 - DNA, 2474 bp, Homo sapiens
ggccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctgcacctccctccccgcgccccgtcctctcccgccctacaggccctagcagggcaggcgggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357517 - DNA, 2509 bp, Homo sapiens
ggccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctgcacctccctccccgcgccccgtcctctcccgccctacaggccctagcagggcaggcgggaggtgagcgcggccatcccgctcccggagttccgggatcctggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357518 - DNA, 1641 bp, Homo sapiens
cctcctcctctgtagcctttgcactgtctctgttacttgtcaccacttgctgtgtgtgtcttcctatttgggctaggttccatgcaggcggggatgtcagtcctatagcccaccacatccttcctcctctctgccccagtgcccagcagagtgaggcctgggaagatgtgtgctgactggtgggctgctctggggggtcttctgggactaggtccagggcaggagctgatgttggcctgctcttttccaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357519 - DNA, 2481 bp, Homo sapiens
ggccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctgcacctccctccccgcgccccgtcctctcccgccctacaggccctagcagggcaggcgggaggtgagcgcggccatcccgctcccggagttccgggatcctggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357520 - DNA, 1740 bp, Homo sapiens
ccccggcccccacccccgcctgtccctccccgaaggaagaagaaccgacctggactgcagcccatagcggaggggcagtccgaggagggccgggctgtcagcccagcggctggcgaggaggccccagccgcgaaggagccgggcgcgcaggccggcctggaggtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357521 - DNA, 2123 bp, Homo sapiens
ggccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctgcacctccctccccgcgccccgtcctctcccgccctacaggccctagcagggcaggcgggaggtgagcgcggccatcccgctcccggagttccgggatcctggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccagcaccaagcagttggagctgtggttttccagtctccaggaagatgcagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357522 - DNA, 1908 bp, Homo sapiens
ggccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctgcacctccctccccgcgccccgtcctctcccgccctacaggccctagcagggcaggcgggaggtgagcgcggccatcccgctcccggagttccgggatcctggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagacccttggtgggtgggcctgtggtgatggtttgcatccttcctcctttgtcccaataaagtatgggagttgaa

SEQ ID NO: 357523 - DNA, 424 bp, Homo sapiens
tggatgggtcacacacacacacacacaccgggaagagcatgcctggatgggctctcacagtctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357524 - DNA, 284 bp, Homo sapiens
gggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatggga

SEQ ID NO: 357525 - DNA, 202 bp, Homo sapiens
agtgcctcacatccccagagaaggccccccctcttccaatctcatctcccatcctccacccagagaggactggagtcctccacctccctgaacttccattccctcttttctcccctagcaccaagcagttggagctgtggttttccagtctccaggaagatgcaggtcagaggttcagatggtagaggatggggctgatggg

SEQ ID NO: 357526 - DNA, 2504 bp, Homo sapiens
ggccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctgcacctccctccccgcgccccgtcctctcccgccctacaggccctagcagggcaggcgggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357527 - DNA, 2804 bp, Homo sapiens
ggccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctgcacctccctccccgcgccccgtcctctcccgccctacaggccctagcagggcaggcgggaggtgagcgcggccatcccgctcccggagttccgggatcctggaggtgggggctgtgccctgagggagggcacagggaaccgggatggggctgggggacagcgagtgctgggaagtgtgcgagatttcactccggggctcgggtcgagctaccccgtgcttcaggcggtcctgcgcctcctctccccaagacccttcggggacacagcactgcagacccgccggagacaacttgtgcgggagcccggagtcctcggaataacacttggtaagtgttaccgcgcccttcttcccttacgccagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357528 - DNA, 2941 bp, Homo sapiens
ggccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctgcacctccctccccgcgccccgtcctctcccgccctacaggccctagcagggcaggcgggaggtgagcgcggccatcccgctcccggagttccgggatcctggaggtgggggctgtgccctgagggagggcacagggaaccgggatggggctgggggacagcgagtgctgggaagtgtgcgagatttcactccggggctcgggtcgagctaccccgtgcttcaggcggtcctgcgcctcctctccccaagacccttcggggacacagcactgcagacccgccggagacaacttgtgcgggagcccggagtcctcggaataacacttggtaagtgttaccgcgcccttcttcccttacgccagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggtgaaggtggctggggggaggctgttgggatgaggagagtaatggagctccgcggggggtgcgggaatggttggcgggaggtggctgggaggtgtctggagggatctctggagccatcggcatcgcgccacctccaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357529 - DNA, 2195 bp, Homo sapiens
ccccggcccccacccccgcctgtccctccccgaaggaagaagaaccgacctggactgcagcccatagcggaggggcagtccgaggagggccgggctgtcagcccagcggctggcgaggaggccccagccgcgaaggagccgggcgcgcaggccggcctggaggtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggtgaaggtggctggggggaggctgttgggatgaggagagtaatggagctccgcggggggtgcgggaatggttggcgggaggtggctgggaggtgtctggagggatctctggagccatcggcatcgcgccacctccaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357530 - DNA, 2398 bp, Homo sapiens
ggccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctgcacctccctccccgcgccccgtcctctcccgccctacaggccctagcagggcaggcgggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccagcaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357531 - DNA, 1596 bp, Homo sapiens
tgtcacctcgggacctaccgtttgaggatagtattttggagatctacggtgcgttggcccaacacggtgcgttggccgttgggccacgcagtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357532 - DNA, 2899 bp, Homo sapiens
ggccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctgcacctccctccccgcgccccgtcctctcccgccctacaggccctagcagggcaggcgggaggtgagcgcggccatcccgctcccggagttccgggatcctggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaaaaaaaaaaaacaaaaaacacacaaccgaacacaaacacaaaaaacaaaacaactccagaacacaacatacacacacaaggacacaaaaaagaattgcgggcggcgcggcgccgccgcggccccgaggaaagagttttctacaacacacactgggggggggggcgcggggcggccccaaagggagaatcacaacacgcgcgacacacatggctgtccgccaagagaacaccggggcacacaacaggggggggggtgctccccaaaaaaaacacagcggggggcccacgcggtgtcgaaaaaccccgggggggcgggggccacagggcctccccaggggccagaggggggaaag

SEQ ID NO: 357533 - DNA, 2186 bp, Homo sapiens
ggccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctgcacctccctccccgcgccccgtcctctcccgccctacaggccctagcagggcaggcgggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357534 - DNA, 817 bp, Homo sapiens
ggcacaggacatctctttgaggtgaccgtctgcggcctgtagtcctgaccacaggctctgagctgcactggccccggtgctggcatctggtggagcggacccactcccctcacattccacaggcccatgcgtggattgccagctggcaatccacgcatggcggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 357535 - DNA, 386 bp, Homo sapiens
cacgccctggtggcggacgggctgaagcctttccggaaggacctcatcaccgggcagcgcaggagcagcccctggagcgtggtggaggcgtcggtgaagccaggtgagccaggagggcgtgggacccggcagtgcgcagggcagggccgggcttggctgactgcaccccacgttctcaggctccagcacccgctcccttggaaccctgtatagccaggtcagccgtctagccccgctgagcagcagccgtagccgcttccatgcctttatcctgggcctcctcaagtgagttgccttctttccagtgcccttcccacgacctgggactgcaggagcgtcatgggtgggacacagtagtagtgcctcacatccccagagaaggcccc

SEQ ID NO: 357536 - DNA, 1515 bp, Homo sapiens
tctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagcttgcctctcctgtgcgtatgggaacacctagcacgtgctggatgggctgcctctgactcagaggcatggccggatttggcaactcaacaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtctttttttttttttttttttttggtatattgctgtatctactttaacttccagaaataaacgttatataggaaccgtcaaaaaaaaaaca

SEQ ID NO: 357537 - DNA, 742 bp, Homo sapiens
tatcggattgcagtggtgcgatctcagctcactgcaacctctgcctcctaggttcaagcgattctcaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtctttttttttttttttttttttggtatattgctgtatctactttaacttccagaaataaacgttatataggaaccgtcaaaaaaaaaaca

SEQ ID NO: 357538 - DNA, 1161 bp, Homo sapiens
tctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccaggtgaggcagaacagctagagggcctccccgcctgcccgccttggctggctagcttgcctctcctgtgcgtatgggaacacctagcacgtgctggatgggctgcctctgactcagaggcatggccggatttggcaactcaacaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtctttttttttttttttttttttggtatattgctgtatctactttaacttccagaaataaacgttatataggaaccgtcaaaaaaaaaaca

SEQ ID NO: 357539 - DNA, 1567 bp, Homo sapiens
tctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagcttgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtctttttttttttttttttttttggtatattgctgtatctactttaacttccagaaataaacgttatataggaaccgtcaaaaaaaaaaca

SEQ ID NO: 357540 - DNA, 441 bp, Homo sapiens
tactactaagttcgcggccgtcagactcgccaaacaccccccacttagggacccacaaggacactcgatcacactgacttggtatcatcaccctcagcttcccaaggggagtcatggcttaggcaggatgccagagatatcctaaatcaaggtgaccgtggggcaactggcaccctttggggacagagggggcagccaagcctccaaagcactgtccctcccccagccctgtctgccctaaagagcccaccaaggtcagaatctcagccaagatttccccagtcggcccttactgagaagctcagccctgtcagtccccaccaggtcccctggaatgggtagccaccggacctggggaccggggcacctctgccagatggacttctagggacatcctcccccttgtacttgctaaataaagtgtcctcaagtttcacagag

SEQ ID NO: 357541 - DNA, 517 bp, Homo sapiens
aaggtttcatccaggcaggcgatgagcaaagcaacccaacccaggccctgcagcctcagtgcctagttctgctccgagagccaaacaagggatctgtctcccaagactcgccaaacaccccccacttagggacccacaaggacactcgatcacactgacttggtatcatcaccctcagcttcccaaggggagtcatggcttaggcaggatgccagagatatcctaaatcaaggtgaccgtggggcaactggcaccctttggggacagagggggcagccaagcctccaaagcactgtccctcccccagccctgtctgccctaaagagcccaccaaggtcagaatctcagccaagatttccccagtcggcccttactgagaagctcagccctgtcagtccccaccaggtcccctggaatgggtagccaccggacctggggaccggggcacctctgccagatggacttctagggacatcctcccccttgtacttgctaaataaagtgtcctcaagtttca

SEQ ID NO: 357542 - DNA, 619 bp, Homo sapiens
taactttttgataggttaaaaacttacaaaaaacgtggatagagggggtctgtcttgcccactagaccgatatggttaggttaggttaggttaggttaggttaggttagaacccgacattgtgctctgtacttcctagccattcattcgcttcaagtgctctgaaatttaatttaaaaaatcatagttggaatcctttcggtcactttctctttctcccttcgttcctccctttccctcttgattcttccttgaggcgcaaacacctgagagaggcttctgtccctcggcggtctccgtaagtaagtgaaccgttattggctggagggcgctgacgtctgattgttgcgcggtcgcatttttccggggagcgcggattcgcattcccaattttaggtggcagtcgcaacccatactattcggacagatggcacagaaaccgctgcgcctgtgagtgaccgtgaatggaagcctctctccctgtgtctctttcgtgtgtgtaggtgacgacacgggcgggagtctttcccatgacgggaagggagaaggaaaaggcggagagacacggggctgctggggagcttaggtgatgtctttgcctggccggggctgacctcttt

SEQ ID NO: 357543 - DNA, 2360 bp, Homo sapiens
taactttttgataggttaaaaacttacaaaaaacgtggatagagggggtctgtcttgcccactagaccgatatggttaggttaggttaggttaggttaggttaggttagaacccgacattgtgctctgtacttcctagccattcattcgcttcaagtgctctgaaatttaatttaaaaaatcatagttggaatcctttcggtcactttctctttctcccttcgttcctccctttccctcttgattcttccttgaggcgcaaacacctgagagaggcttctgtccctcggcggtctccgtaagtaagtgaaccgttattggctggagggcgctgacgtctgattgttgcgcggtcgcatttttccggggagcgcggattcgcattcccaattttaggtggcagtcgcaacccatactattcggacagatggcacagaaaccgctgcgcctcttggcttgtggagatgttgaaggaaagtttgatattttattcaatagagttcaagcaattcagaagaaaagtggaaactttgatctgctgttgtgtgtaggaaatttctttggctccacccaagatgctgaatgggaggagtataagactggcatcaagaaagctcctattcagacatatgtgcttggtgctaataaccaggaaacagtaaaatatttccaggatgctgatggatgtgaattagctgaaaacattacttatctgggtcgtaaaggtatcttcactggaagctcggggctgcagattgtgtacctcagtgggacagaatccttaaatgagccagtaccaggttatagttttagtcccaaggatgtgtcttctctgagaatgatgctgtgtacaacctcccagtttaagggtgttgatatcttgctcacatccccatggcccaagtgtgtggggaactttgggaattcttctggagaagtggataccaaaaaatgtggttctgctttggtttccagtcttgccacgggcttgaaaccaagataccattttgctgctttggaaaagacctattatgagaggcttccatatcgaaaccatatcattctacaggaaaatgcacagcatgccacccggtttatagctctggcaaatgttggaaatccagaaaagaaaaagtatctttacgcgttcagtattgttcccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacaggtcattcctgtcccaatcagctgctctactactgatgacattaaagatgccttcattacccaggcacaggagcagcagatagagctgttggaaatcccagagcactctgacatcaagcagattgcacagccaggagcagcatatttttatgttgaacttgacacaggagaaaagcttttccacagaattaaaaagaattttcctttgcagtttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttaaaaaaaaa

SEQ ID NO: 357544 - DNA, 2880 bp, Homo sapiens
taactttttgataggttaaaaacttacaaaaaacgtggatagagggggtctgtcttgcccactagaccgatatggttaggttaggttaggttaggttaggttaggttagaacccgacattgtgctctgtacttcctagccattcattcgcttcaagtgctctgaaatttaatttaaaaaatcatagttggaatcctttcggtcactttctctttctcccttcgttcctccctttccctcttgattcttccttgaggcgcaaacacctgagagaggcttctgtccctcggcggtctccgtaagtaagtgaaccgttattggctggagggcgctgacgtctgattgttgcgcggtcgcatttttccggggagcgcggattcgcattcccaattttaggtggcagtcgcaacccatactattcggacagatggcacagaaaccgctgcgcctcttggcttgtggagatgttgaaggaaagtttgatattttattcaatagagttcaagcaattcagaagaaaagtggaaactttgatctgctgttgtgtgtaggaaatttctttggctccacccaagatgctgaatgggaggagtataagactggcatcaagaaaggtcgtaaaggtatcttcactggaagctcggggctgcagattgtgtacctcagtgggacagaatccttaaatgagccagtaccaggttatagttttagtcccaaggatgtgtcttctctgagaatgatgctgtgtacaacctcccagtttaagggtgttgatatcttgctcacatccccatggcccaagtgtgtggggaactttgggaattcttctggagaagtggataccaaaaaatgtggttctgctttggtttccagtcttgccacgggcttgaaaccaagataccattttgctgctttggaaaagacctattatgagaggcttccatatcgaaaccatatcattctacaggaaaatgcacagcatgccacccggtttatagctctggcaaatgttggaaatccagaaaagaaaaagtatctttacgcgttcagtattgttcccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacaggtcattcctgtcccaatcagctgctctactactgatgacattaaagatgccttcattacccaggcacaggagcagcagatagagctgttggaaatcccagagcactctgacatcaagcagattgcacagccaggagcagcatatttttatgttgaacttgacacaggagaaaagcttttccacagaattaaaaagaattttcctttgcagtttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtggcataactgtggctcactgtagcctcaacctcctgggctctagagttcctcccacctcagcctcatgagtagctgggaccacaggcgcatgctaccatgcctggcaaacttttttgattttttatagagacaggagggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcgtggtgccaggcacttgtggtcccagctactcaggaggctgaggcaggagaattgcttgagcctgggaggtggaggttgcaggtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttaaaaaaaaa

SEQ ID NO: 357545 - DNA, 2665 bp, Homo sapiens
taactttttgataggttaaaaacttacaaaaaacgtggatagagggggtctgtcttgcccactagaccgatatggttaggttaggttaggttaggttaggttaggttagaacccgacattgtgctctgtacttcctagccattcattcgcttcaagtgctctgaaatttaatttaaaaaatcatagttggaatcctttcggtcactttctctttctcccttcgttcctccctttccctcttgattcttccttgaggcgcaaacacctgagagaggcttctgtccctcggcggtctccgtaagtaagtgaaccgttattggctggagggcgctgacgtctgattgttgcgcggtcgcatttttccggggagcgcggattcgcattcccaattttaggtggcagtcgcaacccatactattcggacagatggcacagaaaccgctgcgcctcttggcttgtggagatgttgaaggaaagtttgatattttattcaatagagttcaagcaattcagaagaaaagtggaaactttgatctgctgttgtgtgtaggaaatttctttggctccacccaagatgctgaatgggaggagtataagactggcatcaagaaagggagaagtggataccaaaaaatgtggttctgctttggtttccagtcttgccacgggcttgaaaccaagataccattttgctgctttggaaaagacctattatgagaggcttccatatcgaaaccatatcattctacaggaaaatgcacagcatgccacccggtttatagctctggcaaatgttggaaatccagaaaagaaaaagtatctttacgcgttcagtattgttcccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacaggtcattcctgtcccaatcagctgctctactactgatgacattaaagatgccttcattacccaggcacaggagcagcagatagagctgttggaaatcccagagcactctgacatcaagcagattgcacagccaggagcagcatatttttatgttgaacttgacacaggagaaaagcttttccacagaattaaaaagaattttcctttgcagtttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtggcataactgtggctcactgtagcctcaacctcctgggctctagagttcctcccacctcagcctcatgagtagctgggaccacaggcgcatgctaccatgcctggcaaacttttttgattttttatagagacaggagggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcgtggtgccaggcacttgtggtcccagctactcaggaggctgaggcaggagaattgcttgagcctgggaggtggaggttgcaggtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttaaaaaaaaa

SEQ ID NO: 357546 - DNA, 2043 bp, Homo sapiens
taactttttgataggttaaaaacttacaaaaaacgtggatagagggggtctgtcttgcccactagaccgatatggttaggttaggttaggttaggttaggttaggttagaacccgacattgtgctctgtacttcctagccattcattcgcttcaagtgctctgaaatttaatttaaaaaatcatagttggaatcctttcggtcactttctctttctcccttcgttcctccctttccctcttgattcttccttgaggcgcaaacacctgagagaggcttctgtccctcggcggtctccgtaagtaagtgaaccgttattggctggagggcgctgacgtctgattgttgcgcggtcgcatttttccggggagcgcggattcgcattcccaattttaggtggcagtcgcaacccatactattcggacagatggcacagaaaccgctgcgcctcttggcttgtggagatgttgaaggaaagtttgatattttattcaatagagttcaagcaattcagaagaaaagtggaaactttgatctgctgttgtgtgtaggaaatttctttggctccacccaagatgctgaatgggaggagtataagactggcatcaagaaagggagaagtggataccaaaaaatgtggttctgctttggtttccagtcttgccacgggcttgaaaccaagataccattttgctgctttggaaaagacctattatgagaggcttccatatcgaaaccatatcattctacaggaaaatgcacagcatgccacccggtttatagctctggcaaatgttggaaatccagaaaagaaaaagtatctttacgcgttcagtattgttcccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacaggtcattcctgtcccaatcagctgctctactactgatgacattaaagatgccttcattacccaggcacaggagcagcagatagagctgttggaaatcccagagcactctgacatcaagcagattgcacagccaggagcagcatatttttatgttgaacttgacacaggagaaaagcttttccacagaattaaaaagaattttcctttgcagtttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttaaaaaaaaa

SEQ ID NO: 357547 - DNA, 1925 bp, Homo sapiens
agatgaacctggcatgtagtgaggacaagtgttgatgtatgactgagacttcaggcatcagaactgggaagatattttgcttccctagagtgtgcagaaaggactgagaagaaagataggtatggcatggcaggaatgttcccttgtatgtgagtggtcggctacttatctaaaggttagttgaataacatttaatcttctgcttttggccattccaggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacaggtcattcctgtcccaatcagctgctctactactgatgacattaaagatgccttcattacccaggcacaggagcagcagatagagctgttggaaatcccagagcactctgacatcaagcagattgcacagccaggagcagcatatttttatgttgaacttgacacaggagaaaagcttttccacagaattaaaaagaattttcctttgcagtttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtggcataactgtggctcactgtagcctcaacctcctgggctctagagttcctcccacctcagcctcatgagtagctgggaccacaggcgcatgctaccatgcctggcaaacttttttgattttttatagagacaggagggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcgtggtgccaggcacttgtggtcccagctactcaggaggctgaggcaggagaattgcttgagcctgggaggtggaggttgcaggtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttaaaaaaaaa

SEQ ID NO: 357548 - DNA, 2479 bp, Homo sapiens
taactttttgataggttaaaaacttacaaaaaacgtggatagagggggtctgtcttgcccactagaccgatatggttaggttaggttaggttaggttaggttaggttagaacccgacattgtgctctgtacttcctagccattcattcgcttcaagtgctctgaaatttaatttaaaaaatcatagttggaatcctttcggtcactttctctttctcccttcgttcctccctttccctcttgattcttccttgaggcgcaaacacctgagagaggcttctgtccctcggcggtctccgtaagtaagtgaaccgttattggctggagggcgctgacgtctgattgttgcgcggtcgcatttttccggggagcgcggattcgcattcccaattttaggtggcagtcgcaacccatactattcggacagatggcacagaaaccgctgcgcctcttggcttgtggagatgttgaaggaaagtttgatattttattcaatagagttcaagcaattcagaagaaaagtggaaactttgatctgctgttgtgtgtaggaaatttctttggctccacccaagatgctgaatgggaggagtataagactggcatcaagaaagctcctattcagacatatgtgcttggtgctaataaccaggaaacagtaaaatatttccaggatgctgatggatgtgaattagctgaaaacattacttatctgggtcgtaaaggtatcttcactggaagctcggggctgcagattgtgtacctcagtgggacagaatccttaaatgagccagtaccaggttatagttttagtcccaaggatgtgtcttctctgagaatgatgctgtgtacaacctcccagtttaagggtgttgatatcttgctcacatccccatggcccaagtgtgtggggaactttgggaattcttctggagaagtggataccaaaaaatgtggttctgctttggtttccagtcttgccacgggcttgaaaccaagataccattttgctgctttggaaaagacctattatgagaggcttccatatcgaaaccatatcattctacaggaaaatgcacagcatgccacccggtttatagctctggcaaatgttggaaatccagaaaagaaaaagtatctttacgcgttcagtattgttcccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacaggtcattcctgtcccaatcagctgctctactactgatgacattaaagatgccttcattacccaggcacaggagcagcagatagagctgttggaaatcccagagcactctgacatcaagcagattgcacagccaggagcagcatatttttatgttgaacttgacacaggagaaaagcttttccacagaattaaaaagaattttcctttgcagtttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtggcataactgtggctcactgtagcctcaacctcctgggctctagagttcctcccacctcagctactcaggaggctgaggcaggagaattgcttgagcctgggaggtggaggttgcaggtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttaaaaaaaaa

SEQ ID NO: 357549 - DNA, 1634 bp, Homo sapiens
gttgtggtggttttctttttggcacatttgttaagttttcaaatgggcctaactctgccacatatataatatcggagatggcaaaggcttgtgacggagatatctctcttaagcctttcctgcatcagagaatggctcccacatgtgtcaggctatctcataagtttaagtccttacagacaggctgacacaggcttgtctggcctgaggatattctgtgctgaggggtgtttctccacccctgtgatggatttgctacttctcagagactgtgcaggcacaacttctctgggacctgcacaaggaatttctcctgtctccccaacccccaggtcattcctgtcccaatcagctgctctactactgatgacattaaagatgccttcattacccaggcacaggagcagcagatagagctgttggaaatcccagagcactctgacatcaagcagattgcacagccaggagcagcatatttttatgttgaacttgacacaggagaaaagcttttccacagaattaaaaagaattttcctttgcagtttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtggcataactgtggctcactgtagcctcaacctcctgggctctagagttcctcccacctcagcctcatgagtagctgggaccacaggcgcatgctaccatgcctggcaaacttttttgattttttatagagacaggagggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcgtggtgccaggcacttgtggtcccagctactcaggaggctgaggcaggagaattgcttgagcctgggaggtggaggttgcaggtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttaaaaaaaaa

SEQ ID NO: 357550 - DNA, 959 bp, Homo sapiens
taactttttgataggttaaaaacttacaaaaaacgtggatagagggggtctgtcttgcccactagaccgatatggttaggttaggttaggttaggttaggttaggttagaacccgacattgtgctctgtacttcctagccattcattcgcttcaagtgctctgaaatttaatttaaaaaatcatagttggaatcctttcggtcactttctctttctcccttcgttcctccctttccctcttgattcttccttgaggcgcaaacacctgagagaggcttctgtccctcggcggtctccgtaagtaagtgaaccgttattggctggagggcgctgacgtctgattgttgcgcggtcgcatttttccggggagcgcggattcgcattcccaattttaggtggcagtcgcaacccatactattcggacagatggcacagaaaccgctgcgcctcttggcttgtggagatgttgaaggaaagtttgatattttattcaatagagttcaagcaattcagaagaaaagtggaaactttgatctgctgttgtgtgtaggaaatttctttggctccacccaagatgctgaatgggaggagtataagactggcatcaagaaagctcctattcagacatatgtgcttggtgctaataaccaggaaacagtaaaatatttccaggatgctgatggatgtgaattagctgaaaacattacttatctgggtcgtaaaggtatcttcactggaagctcggggctgcagattgtgtacctcagtgggacagaatccttaaatgagccagtaccaggttatagttttagtcccaaggatgtgtcttctctgagaatgatgctgtgtacaacctcccagtttaagggtgttgatatcttgctcacatccccatggcccaagtgtgtggggaactttgggaattcttctgtgagtagtgtttgtttagttggaatttc

SEQ ID NO: 357551 - DNA, 1241 bp, Homo sapiens
taactttttgataggttaaaaacttacaaaaaacgtggatagagggggtctgtcttgcccactagaccgatatggttaggttaggttaggttaggttaggttaggttagaacccgacattgtgctctgtacttcctagccattcattcgcttcaagtgctctgaaatttaatttaaaaaatcatagttggaatcctttcggtcactttctctttctcccttcgttcctccctttccctcttgattcttccttgaggcgcaaacacctgagagaggcttctgtccctcggcggtctccgtaagtaagtgaaccgttattggctggagggcgctgacgtctgattgttgcgcggtcgcatttttccggggagcgcggattcgcattcccaattttaggtggcagtcgcaacccatactattcggacagatggcacagaaaccgctgcgcctggagaagtggataccaaaaaatgtggttctgctttggtttccagtcttgccacgggcttgaaaccaagataccattttgctgctttggaaaagacctattatgagaggcttccatatcgaaaccatatcattctacaggaaaatgcacagcatgccacccggtttatagctctggcaaatgttggaaatccagaaaagaaaaagatggagtctctgtctattgcccaggctggagtgtagtggcacgatctcggcttactgcaacctccacctcccatgttcaagcgattctcctgcctcagcctcctgagtagctggaactatagtatctttacgcgttcagtattgttcccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttaaaaaaaaa

SEQ ID NO: 357552 - DNA, 2982 bp, Homo sapiens
taactttttgataggttaaaaacttacaaaaaacgtggatagagggggtctgtcttgcccactagaccgatatggttaggttaggttaggttaggttaggttaggttagaacccgacattgtgctctgtacttcctagccattcattcgcttcaagtgctctgaaatttaatttaaaaaatcatagttggaatcctttcggtcactttctctttctcccttcgttcctccctttccctcttgattcttccttgaggcgcaaacacctgagagaggcttctgtccctcggcggtctccgtaagtaagtgaaccgttattggctggagggcgctgacgtctgattgttgcgcggtcgcatttttccggggagcgcggattcgcattcccaattttaggtggcagtcgcaacccatactattcggacagatggcacagaaaccgctgcgcctcttggcttgtggagatgttgaaggaaagtttgatattttattcaatagagttcaagcaattcagaagaaaagtggaaactttgatctgctgttgtgtgtaggaaatttctttggctccacccaagatgctgaatgggaggagtataagactggcatcaagaaagctcctattcagacatatgtgcttggtgctaataaccaggaaacagtaaaatatttccaggatgctgatggatgtgaattagctgaaaacattacttatctgggtcgtaaaggtatcttcactggaagctcggggctgcagattgtgtacctcagtgggacagaatccttaaatgagccagtaccaggttatagttttagtcccaaggatgtgtcttctctgagaatgatgctgtgtacaacctcccagtttaagggtgttgatatcttgctcacatccccatggcccaagtgtgtggggaactttgggaattcttctggagaagtggataccaaaaaatgtggttctgctttggtttccagtcttgccacgggcttgaaaccaagataccattttgctgctttggaaaagacctattatgagaggcttccatatcgaaaccatatcattctacaggaaaatgcacagcatgccacccggtttatagctctggcaaatgttggaaatccagaaaagaaaaagtatctttacgcgttcagtattgttcccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacaggtcattcctgtcccaatcagctgctctactactgatgacattaaagatgccttcattacccaggcacaggagcagcagatagagctgttggaaatcccagagcactctgacatcaagcagattgcacagccaggagcagcatatttttatgttgaacttgacacaggagaaaagcttttccacagaattaaaaagaattttcctttgcagtttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtggcataactgtggctcactgtagcctcaacctcctgggctctagagttcctcccacctcagcctcatgagtagctgggaccacaggcgcatgctaccatgcctggcaaacttttttgattttttatagagacaggagggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcgtggtgccaggcacttgtggtcccagctactcaggaggctgaggcaggagaattgcttgagcctgggaggtggaggttgcaggtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttaaaaaaaaa

SEQ ID NO: 357553 - DNA, 2485 bp, Homo sapiens
taactttttgataggttaaaaacttacaaaaaacgtggatagagggggtctgtcttgcccactagaccgatatggttaggttaggttaggttaggttaggttaggttagaacccgacattgtgctctgtacttcctagccattcattcgcttcaagtgctctgaaatttaatttaaaaaatcatagttggaatcctttcggtcactttctctttctcccttcgttcctccctttccctcttgattcttccttgaggcgcaaacacctgagagaggcttctgtccctcggcggtctccgtaagtaagtgaaccgttattggctggagggcgctgacgtctgattgttgcgcggtcgcatttttccggggagcgcggattcgcattcccaattttaggtggcagtcgcaacccatactattcggacagatggcacagaaaccgctgcgcctggagaagtggataccaaaaaatgtggttctgctttggtttccagtcttgccacgggcttgaaaccaagataccattttgctgctttggaaaagacctattatgagaggcttccatatcgtttagcattcagatcttctcttctccctgactgcaaggtctcagcagtttcggagactcctttgtaaagtatctttacgcgttcagtattgttcccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacaggtcattcctgtcccaatcagctgctctactactgatgacattaaagatgccttcattacccaggcacaggagcagcagatagagctgttggaaatcccagagcactctgacatcaagcagattgcacagccaggagcagcatatttttatgttgaacttgacacaggagaaaagcttttccacagaattaaaaagaattttcctttgcagtttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtggcataactgtggctcactgtagcctcaacctcctgggctctagagttcctcccacctcagcctcatgagtagctgggaccacaggcgcatgctaccatgcctggcaaacttttttgattttttatagagacaggagggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcgtggtgccaggcacttgtggtcccagctactcaggaggctgaggcaggagaattgcttgagcctgggaggtggaggttgcaggtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttaaaaaaaaa

SEQ ID NO: 357554 - DNA, 2862 bp, Homo sapiens
taactttttgataggttaaaaacttacaaaaaacgtggatagagggggtctgtcttgcccactagaccgatatggttaggttaggttaggttaggttaggttaggttagaacccgacattgtgctctgtacttcctagccattcattcgcttcaagtgctctgaaatttaatttaaaaaatcatagttggaatcctttcggtcactttctctttctcccttcgttcctccctttccctcttgattcttccttgaggcgcaaacacctgagagaggcttctgtccctcggcggtctccgtaagtaagtgaaccgttattggctggagggcgctgacgtctgattgttgcgcggtcgcatttttccggggagcgcggattcgcattcccaattttaggtggcagtcgcaacccatactattcggacagatggcacagaaaccgctgcgcctcttggcttgtggagatgttgaaggaaagtttgatattttattcaatagagttcaagcaattcagaagaaaagtggaaactttgatctgctgttgtgtgtaggaaatttctttggctccacccaagatgctgaatgggaggagtataagactggcatcaagaaagctcctattcagacatatgtgcttggtgctaataaccaggaaacagtaaaatatttccaggatgctgatggatgtgaattagctgaaaacattacttatctgggtcgtaaaggtatcttcactggaagctcggggctgcagattgtgtacctcagtgggacagaatccttaaatgagccagtaccaggttatagttttagtcccaaggatgtgtcttctctgagaatgatgctgtgtacaacctcccagtttaagggtgttgatatcttgctcacatccccatggcccaagtgtgtggggaactttgggaattcttctggagaagtggataccaaaaaatgtggttctgctttggtttccagtcttgccacgggcttgaaaccaagataccattttgctgctttggaaaagacctattatgagaggcttccatatcgaaaccatatcattctacaggaaaatgcacagcatgccacccggtttatagctctggcaaatgttggaaatccagaaaagaaaaagtatctttacgcgttcagtattgttcccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacagattgcacagccaggagcagcatatttttatgttgaacttgacacaggagaaaagcttttccacagaattaaaaagaattttcctttgcagtttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtggcataactgtggctcactgtagcctcaacctcctgggctctagagttcctcccacctcagcctcatgagtagctgggaccacaggcgcatgctaccatgcctggcaaacttttttgattttttatagagacaggagggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcgtggtgccaggcacttgtggtcccagctactcaggaggctgaggcaggagaattgcttgagcctgggaggtggaggttgcaggtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttaaaaaaaaa

SEQ ID NO: 357555 - DNA, 1600 bp, Homo sapiens
taactttttgataggttaaaaacttacaaaaaacgtggatagagggggtctgtcttgcccactagaccgatatggttaggttaggttaggttaggttaggttaggttagaacccgacattgtgctctgtacttcctagccattcattcgcttcaagtgctctgaaatttaatttaaaaaatcatagttggaatcctttcggtcactttctctttctcccttcgttcctccctttccctcttgattcttccttgaggcgcaaacacctgagagaggcttctgtccctcggcggtctccgtaagtaagtgaaccgttattggctggagggcgctgacgtctgattgttgcgcggtcgcatttttccggggagcgcggattcgcattcccaattttaggtggcagtcgcaacccatactattcggacagatggcacagaaaccgctgcgcctcttggcttgtggagatgttgaaggaaagtttgatattttattcaatagagttcaagcaattcagaagaaaagtggaaactttgatctgctgttgtgtgtaggaaatttctttggctccacccaagatgctgaatgggaggagtataagactggcatcaagaaagctcctattcagacatatgtgcttggtgctaataaccaggaaacagtaaaatatttccaggatgctgatggatgtgaattagctgaaaacattacttatctgggtcgtaaaggtatcttcactggaagctcggggctgcagattgtgtacctcagtgggacagaatccttaaatgagccagtaccaggttatagttttagtcccaaggatgtgtcttctctgagaatgatgctgtgtacaacctcccagtttaagggtgttgatatcttgctcacatccccatggcccaagtgtgtggggaactttgggaattcttctggagaagtggataccaaaaaatgtggttctgctttggtttccagtcttgccacgggcttgaaaccaagataccattttgctgctttggaaaagacctattatgagaggcttccatatcgaaaccatatcattctacaggaaaatgcacagcatgccacccggtttatagctctggcaaatgttggaaatccagaaaagaaaaagtatctttacgcgttcagtattgttcccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttaaaaaaaaa

SEQ ID NO: 357556 - DNA, 403 bp, Homo sapiens
cacaaccagttccagtgttttctctttcttttatcaatgctgaatattgaaaaagggcatgctgcctgtttcaacttagcgtgactccatgcttatgggtttcctcttccaggcaagggtataaagtgggccctgcaaattatgtagccagccctgctcagacccagctaaggcatcagagcaccagaagtctgcccagcggagaatttccaggagactgctgggcaacagacaacaagccagaggtcctaatttcagggttcatgttcatgaggtcaaagaactctgtggactgtaggaagccaagagaatgaattcacacatttccgggatgatgtaaatttatcggcttaaaacagttttttctattactcccataaataaacataacagccattgaacg

SEQ ID NO: 357557 - DNA, 2000 bp, Homo sapiens
  misc_feature (3)..(3): n is a, c, g, or t
  misc_feature (11)..(12): n is a, c, g, or t
  misc_feature (16)..(16): n is a, c, g, or t
tcncgctggcnngagncgggggtgcaaccctttgaagtgtcccctcctacttcttgctgcctcacggttgctgttgcagacccaggagtctctgaaggcttccgcggctttggggccggttgtgagatgccaggcagaggccgctgcccggactgcggctccacggagctggtggaagactcgcactattcgcagagccagctggtgtgctccgactgcggctgcgtggtcaccgagggggtccttaccactaccttcagcgacgagggcaatctccgagaggtaacatattcccgaagcacaggggaaaacgaacaagttagtcgcagccagcaacgaggtctccggcgagtgagagacctttgtcgagttctgcagttgccaccaacatttgaggataccgcggttgcctactaccaacaggcatatcggcactctggcatccgagcggccaggctgcaaaagaaggaggtgttggttgggtgctgcgtcttaatcacctgccgacagcataactggcccctaacaatgggggccatctgcacgctgttgtatgcagatttggatgtgttttctagcacttacatgcagatagtgaagctcctgggactggatgtgccatctctgtgcttggcagaactggtgaagacctattgcagcagcttcaaactgttccaagcttcaccttctgtgccagccaaatacgtggaagacaaagagaagatgctgtctcgaacaatgcagttggtggagctggcaaatgagacgtggctggtgaccgggaggcatcccttgcccgtcatcactgctgcgactttcctggcttggcagtcgctgcagcctgcagatcggctttcatgttcccttgcccgattttgtaaattggcaaatgtggacctgccctacccggcgtcctcccgcctgcaggagctgctggctgtgctgctgcggatggctgagcagctggcctggttacgagttctgagacttgacaaacggtctgtggtgaagcacatcggtgaccttctccagcaccgccagtcactggtccgctctgcctttcgggatgggacagcagaagtggagacccgagagaaggagccaccggggtggggacaggggcaaggagaaggggaggtgggaaataattccttaggtttaccccaggggaagcggccggccagtcctgcccttctcttgccaccctgcatgttgaagtccccgaagcggatctgccctgtaccccctgtctccactgtcactggagatgagaacatttctgatagtgaaatagaacagtatttgcgtacccctcaggaagttagggactttcagagagcccaggctgctagacaggctgccacgagtgtccctaaccctccctgatggatatccactgggagcacttcatcctgttctgacagcttgataacattcctgttataaccaaggatggaagtgtacaccagtccgtaggtattgcttttcttgtttgaaggaaccaagaggggctctgccattagttggaccctgggtcctggagtaaagtcaggagtgcagggatgactataggtaggagagattcccatcccttggtgtgggagagcaagttgcctatgtccatgttctgtgagatggctttcctcatagatggatgggaaaatgtcaggctctttgctgctggtttgaattggacacactgctgcggctcctcctgcaggcctgagggggcttccctctgcttgtggagtggttggcattcccagcagtatcaaccctcagaggagcgggaactggggaattctggccctacgtgcattcacaggcaatgatgggtttgtgtgtatggtgtcatgagatcctctacctcataacaaaaggacagtgggtagactaaggcagtagctcaaagggctttgcaaaattttaatatattaaaacaagaggcatctgctagaaaacattctattgtataaaacccgagttcttaaaaacatgtt

SEQ ID NO: 357558 - DNA, 2089 bp, Homo sapiens
  misc_feature (3)..(3): n is a, c, g, or t
  misc_feature (11)..(12): n is a, c, g, or t
  misc_feature (16)..(16): n is a, c, g, or t
tcncgctggcnngagncgggggtgcaaccctttgaagtgtcccctcctacttcttgctgcctcacggttgctgttgcagacccaggagtctctgaaggcttccgcggctttggggccggttgtgagatgccaggcagaggccgctgcccggactgcggctccacggagctggtggaagactcgcactattcgcagagccagctggtgtgctccgactgcggctgcgtggtcaccgagggggtccttaccactaccttcagcgacgagggcaatctccgagaggtaacatattcccgaagcacaggggaaaacgaacaagttagtcgcagccagcaacgaggtctccggcgagtgagagacctttgtcgagttctgcagttgccaccaacatttgaggataccgcggttgcctactaccaacaggcatatcggcactctggcatccgagcggccaggctgcaaaagaaggaggtgttggttgggtgctgcgtcttaatcacctgccgacagcataactggcccctaacaatgggggccatctgcacgctgttgtatgcagatttggatgtgttttctagcacttacatgcagatagtgaagctcctgggactggatgtgccatctctgtgcttggcagaactggtgaagacctattgcagcagcctggagtgcagtggcaccatcatagctcactgcagcctggaactcatgggctcaagcgatctgcccacctgatcctcccaaaatgcagcttcaaactgttccaagcttcaccttctgtgccagccaaatacgtggaagacaaagagaagatgctgtctcgaacaatgcagttggtggagctggcaaatgagacgtggctggtgaccgggaggcatcccttgcccgtcatcactgctgcgactttcctggcttggcagtcgctgcagcctgcagatcggctttcatgttcccttgcccgattttgtaaattggcaaatgtggacctgccctacccggcgtcctcccgcctgcaggagctgctggctgtgctgctgcggatggctgagcagctggcctggttacgagttctgagacttgacaaacggtctgtggtgaagcacatcggtgaccttctccagcaccgccagtcactggtccgctctgcctttcgggatgggacagcagaagtggagacccgagagaaggagccaccggggtggggacaggggcaaggagaaggggaggtgggaaataattccttaggtttaccccaggggaagcggccggccagtcctgcccttctcttgccaccctgcatgttgaagtccccgaagcggatctgccctgtaccccctgtctccactgtcactggagatgagaacatttctgatagtgaaatagaacagtatttgcgtacccctcaggaagttagggactttcagagagcccaggctgctagacaggctgccacgagtgtccctaaccctccctgatggatatccactgggagcacttcatcctgttctgacagcttgataacattcctgttataaccaaggatggaagtgtacaccagtccgtaggtattgcttttcttgtttgaaggaaccaagaggggctctgccattagttggaccctgggtcctggagtaaagtcaggagtgcagggatgactataggtaggagagattcccatcccttggtgtgggagagcaagttgcctatgtccatgttctgtgagatggctttcctcatagatggatgggaaaatgtcaggctctttgctgctggtttgaattggacacactgctgcggctcctcctgcaggcctgagggggcttccctctgcttgtggagtggttggcattcccagcagtatcaaccctcagaggagcgggaactggggaattctggccctacgtgcattcacaggcaatgatgggtttgtgtgtatggtgtcatgagatcctctacctcataacaaaaggacagtgggtagactaaggcagtagctcaaagggctttgcaaaattttaatatattaaaacaagaggcatctgctagaaaacattctattgtataaaacccgagttcttaaaaacatgtt

SEQ ID NO: 357559 - DNA, 898 bp, Homo sapiens
  misc_feature (3)..(3): n is a, c, g, or t
  misc_feature (11)..(12): n is a, c, g, or t
  misc_feature (16)..(16): n is a, c, g, or t
  misc_feature (812)..(812): n is a, c, g, or t
  misc_feature (815)..(815): n is a, c, g, or t
  misc_feature (857)..(857): n is a, c, g, or t
  misc_feature (863)..(863): n is a, c, g, or t
  misc_feature (891)..(891): n is a, c, g, or t
tcncgctggcnngagncgggggtgcaaccctttgaagtgtcccctcctacttcttgctgcctcacggttgctgttgcagacccaggagtctctgaaggcttccgcggctttggggccggttgtgagatgccaggcagaggccgctgcccggactgcggctccacggagctggtggaagactcgcactattcgcagagccagctggtgtgctccgactgcggctgcgtggtcaccgagggggtccttaccactaccttcagcgacgagggcaatctccgagaggtaacatattcccgaagcacaggggaaaacgaacaagttagtcgcagccagcaacgaggtctccggcgagtgagagacctttgtcgagttctgcagttgccaccaacatttgaggataccgcggttgcctactaccaacaggcatatcggcactctggcatccgagcggccaggctgcaaaagaaggaggtgttggttgggtgctgcgtcttaatcacctgccgacagcataactggcccctaacaatgggggccatctgcacgctgttgtatgcagatttggatgtgttttctagcacttacatgcagatagtgaagctcctgggactggatgtgccatctctgtgcttggcagaactggtgaagacctattgcagcagcttcaaactgttccaagcttcaccttctgtgccagccaaatacgtggaagacaaagagaagatgctgtctcgaacaatgcagttggtggagctggcaaatgagacgtggctggtgaccgggaggcatcccttgcccgttaatcaacggcntgngaacttttccctggccttgggaaattcccctgcaaaccttgnaaaatnggggtttcaaaggttccccctttgcccnaattttt

SEQ ID NO: 357560 - DNA, 1660 bp, Homo sapiens
  misc_feature (3)..(3): n is a, c, g, or t
  misc_feature (11)..(12): n is a, c, g, or t
  misc_feature (16)..(16): n is a, c, g, or t
tcncgctggcnngagncgggggtgcaaccctttgaagtgtcccctcctacttcttgctgcctcacggttgctgttgcagacccaggagtctctgaaggcttccgcggctttggggccggttgtgagatgccaggcagaggccgctgcccggactgcggctccacggagctggtggaagactcgcactattcgcagagccagctggtgtgctccgactgcggctgcgtggtcaccgagggggtccttaccactaccttcagcgacgagggcaatctccgagaggtaacatattcccgaagcacaggggaaaacgaacaagttagtcgcagccagcaacgaggtctccggcgagtgagagacctttgtcgagttctgcagttgccaccaacatttgaggataccgcggttgcctactaccaacaggcatatcggcactctggcatccgagcggccaggctgcaaaagaaggaggtgttggttgggtgctgcgtcttaatcacctgccgacagcataactggcccctaacaatgggggccatctgcacgctgttgtatgcagatttggatgtgttttctagcacttacatgcagatagtgaagctcctgggactggatgtgccatctctgtgcttggcagaactggtgaagacctattgcagcagcttcaaactgttccaagcttcaccttctgtgccagccaaatacgtggaagacaaagagaagatgctgtctcgaacaatgcagttggtggagctggcaaatgagacgtggctggtgaccgggaggcatcccttgcccgtcatcactgctgcgactttcctggcttggcagtcgctgcagcctgcagatcggctttcatgttcccttgcccgattttgtaaattggcaaatgtggacctgccctacccggcgtcctcccgcctgcaggagctgctggctgtgctgctgcggatggctgagcagctggcctggttacgagttctgagacttgacaaacggtctgtggtgaagcacatcggtgaccttctccagcaccgccagtcactggtccgctctgcctttcgggatgggacagcagaagtggagacccgagagaaggagccaccggggtggggacaggggcaaggagaaggggaggtgggaaataattccttaggtttaccccaggggaagcggccggccagtcctgcccttctcttgccaccctgcatgttgaagtccccgaagcggatctgccctgtaccccctgtctccactgtcactggagatgagaacatttctgatagtgaaatagaacagtatttgcgtacccctcaggaagttagggactttcagagagcccaggctgctagacaggctgccacgagtgtccctaaccctccctgagggggcttccctctgcttgtggagtggttggcattcccagcagtatcaaccctcagaggagcgggaactggggaattctggccctacgtgcattcacaggcaatgatgggtttgtgtgtatggtgtcatgagatcctctacctcataacaaaaggacagtgggtagactaaggcagtagctcaaagggctttgcaaaattttaatatattaaaacaagaggcatctgctagaaaacattctattgtataaaacccgagttcttaaaaacatgtt

SEQ ID NO: 357561 - DNA, 1742 bp, Homo sapiens
ctgataaataacgttgaaagtagaggctgttggtgtcaaatagccttgtatttgaagcttggttactgcctggctggatgactatgggaaagttttttaactatacatgcacataagatggtgcacgtgcacgtagattaaatgagaacgttgtaaagcactcagaataatggtgattgggaggcgcccaataaatgttcgtgctctcctccatccctccaccttcccctaacaagcggaagacgccctgttttctctcactacctttattaacttgctgcccagtgagcttgagtattcctgagggcagaatagcttccccatcttgagtgggctgtctttcctcactgtgggagagcagcccctatatcattaagatccaaccctcattttggttatttcagcttcaaactgttccaagcttcaccttctgtgccagccaaatacgtggaagacaaagagaagatgctgtctcgaacaatgcagttggtggagctggcaaatgagacgtggctggtgaccgggaggcatcccttgcccgtcatcactgctgcgactttcctggcttggcagtcgctgcagcctgcagatcggctttcatgttcccttgcccgattttgtaaattggcaaatgtggacctgccctacccggcgtcctcccgcctgcaggagctgctggctgtgctgctgcggatggctgagcagctggcctggttacgagttctgagacttgacaaacggtctgtggtgaagcacatcggtgaccttctccagcaccgccagtcactggtccgctctgcctttcgggatgggacagcagaagtggagacccgagagaaggagccaccggggtggggacaggggcaaggagaaggggaggtgggaaataattccttaggtttaccccaggggaagcggccggccagtcctgcccttctcttgccaccctgcatgttgaagtccccgaagcggatctgccctgtaccccctgtctccactgtcactggagatgagaacatttctgatagtgaaatagaacagtatttgcgtacccctcaggaagttagggactttcagagagcccaggctgctagacaggctgccacgagtgtccctaaccctccctgatggatatccactgggagcacttcatcctgttctgacagcttgataacattcctgttataaccaaggatggaagtgtacaccagtccgtaggtattgcttttcttgtttgaaggaaccaagaggggctctgccattagttggaccctgggtcctggagtaaagtcaggagtgcagggatgactataggtaggagagattcccatcccttggtgtgggagagcaagttgcctatgtccatgttctgtgagatggctttcctcatagatggatgggaaaatgtcaggctctttgctgctggtttgaattggacacactgctgcggctcctcctgcaggcctgagggggcttccctctgcttgtggagtggttggcattcccagcagtatcaaccctcagaggagcgggaactggggaattctggccctacgtgcattcacaggcaatgatgggtttgtgtgtatggtgtcatgagatcctctacctcataacaaaaggacagtgggtagactaaggcagtagctcaaagggctttgcaaaattttaatatattaaaacaagaggcatctgctagaaaacattctattgtataaaacccgagttcttaaaaacatgtt

SEQ ID NO: 357562 - DNA, 2756 bp, Homo sapiens
agggacagcccagaggaggcgtggccacgctgccggcggaagtggagccctccgcgagcgcgcgaggccgccggggaggcggggaaaccggacagtaggggcggggcgggccggcgatggggatgcgggagcactacgcggagctgcacccgtgcccgccggaattggggatgcagagcagcggcagcgggtatggcaggcaccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtacacttcggggctgcgagcgcggagggcgacgacgacgaagcgcagcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtcc

SEQ ID NO: 357563 - DNA, 2368 bp, Homo sapiens
gagggatgaaaacgataggctaggtacgaggccggtggttaggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtcc

SEQ ID NO: 357564 - DNA, 2997 bp, Homo sapiens
gagggatgaaaacgataggctaggtacgaggccggtggttaggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgtaaggattttgcccactgggcaactcagaaatacttcgatctcccaagatataagaggcagcagcaaacgtgcctattgacgtctgtttcatagttaccacttacgcgagtagacagaactcggcttttcagaaaataggtgtcaagtccactttataagaacctttttttctaaaataagataaaaggtggctttgcattttctgattaaacgactgtgtctttgtcacctctgcttaactttaggagtatccattcctgtgattgtagacttttgttgatattcttcctggaagaatatcattcttttcttgaagggttggtttactagaatattcaaaatcaatcatgaaggcagttactattttgagtctaaaggttttctaaaaattaacctcacatcccttctgttagggtctttcagaatatcttttataaacagaagcatttgaagtcattgcttttgctacatgatttgtgtgtgtgaaggacataccacgtttaaatcattaattgaaaaacatcatataagccccaactttgtttggaggaagagacggaggttgaggtttttccttctgtataagcacctactgacaaaatgtagaggccattcaaccgtcaaacaccatttggttatatcgcagaggagacggatgtgtaaattactgcattgctttttttttcagtttgtataacctctaatctccgtttgcatgatacgctttgttagaaacattaattgtagtttggaagcaagtgtgtatgggaattc

SEQ ID NO: 357565 - DNA, 2226 bp, Homo sapiens
gagggatgaaaacgataggctaggtacgaggccggtggttaggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtcc

SEQ ID NO: 357566 - DNA, 2604 bp, Homo sapiens
gagggatgaaaacgataggctaggtacgaggccggtggttaggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggtaggtgatgccttcgaggcccagcaaggcagaactgggcatgccctgtgtgcgggcactggagctcccactgagacactcacgcactggtccacaccctgagagagctggtgctgaggctgccctttccgccacgtaggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcaggtgaggaaagggtgggggctggggacagagcccagcgggcaggggcggggtgagggtggagctacctcatgcctctcctccacccgtcactctccagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtcc

SEQ ID NO: 357567 - DNA, 1627 bp, Homo sapiens
gagggatgaaaacgataggctaggtacgaggccggtggttaggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcacccccccttgtccaggtgaggtgagcacatttacagatattgtgcgtcatagccccatgccctctgcccagctcagtttagacagtaaacgttccttgtttcttttctcccatgacactgacaagaggtattaccacctcagctt

SEQ ID NO: 357568 - DNA, 1623 bp, Homo sapiens
gagggatgaaaacgataggctaggtacgaggccggtggttaggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtcc

SEQ ID NO: 357569 - DNA, 1213 bp, Homo sapiens
gagggatgaaaacgataggctaggtacgaggccggtggttaggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaagacggagctcggtcgtcatgcgcacgaagggcgtgtggctcccgccatcaagacgttcaggatgagggcgctcgtgtatgccgtcaggtagcgttcccgctctggtattctgtggccggaggtccggttcccgctccgatcgcctcgtgggtttggagagcctgcgcggcttctgggtcctcatcgtggtgtacacggcctcgctgggctggacgcggaataccagtctcgtggcgcttgctgtgctgggtggagatgtcggcg

SEQ ID NO: 357570 - DNA, 1094 bp, Homo sapiens
gagggatgaaaacgataggctaggtacgaggccggtggttaggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaagacggctgcaaaagtggcggtggtggacccgcggggcaccgtggggtcgtccaggtaccctttggtggcctcgccctctccatcggggttccccacgtactgtcctacgaccacagttgttgcctgcacctctgagatcactcag

SEQ ID NO: 357571 - DNA, 714 bp, Homo sapiens
  misc_feature (584)..(584): n is a, c, g, or t
  misc_feature (587)..(587): n is a, c, g, or t
  misc_feature (608)..(608): n is a, c, g, or t
  misc_feature (620)..(620): n is a, c, g, or t
  misc_feature (660)..(660): n is a, c, g, or t
  misc_feature (701)..(701): n is a, c, g, or t
cgagaactcgggaagccggcgagaagtgtgaggccgcggtagggccgcatcccgctccggagagaagtctgagtccgccaggctctgcaggcccgcggaagctcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacaanacnacattaacacagaagggctgnaacgcatcaacnagggaaaccttcgggaaggaactgtagaagagctggaacnggtgtgccaacacaattcctctctgtttcctggaagaaccnaaataccgcatat

SEQ ID NO: 357572 - DNA, 2453 bp, Homo sapiens
  misc_feature (28)..(29): n is a, c, g, or t
  misc_feature (40)..(40): n is a, c, g, or t
tagagagagaaacagagagacatacggnnaggtacaggcnggtgttcccaggcgcccgcccccgcccccgccgattaaatgggccggcggggctcagcccccggaaacggtcgtacacttcggggctgcgagcgcggagggcgacgacgacgaagcgcagcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtcc

SEQ ID NO: 357573 - DNA, 2398 bp, Homo sapiens
cgagaactcgggaagccggcgagaagtgtgaggccgcggtagggccgcatcccgctccggagagaagtctgagtccgccaggctctgcaggcccgcggaagctcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtcc

SEQ ID NO: 357574 - DNA, 1669 bp, Homo sapiens
  misc_feature (1642)..(1642): n is a, c, g, or t
  misc_feature (1655)..(1655): n is a, c, g, or t
gagggatgaaaacgataggctaggtacgaggccggtggttaggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctggncatcgaagggatnctcaagagcagctc

SEQ ID NO: 357575 - DNA, 1790 bp, Homo sapiens
gagggatgaaaacgataggctaggtacgaggccggtggttaggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtcc

SEQ ID NO: 357576 - DNA, 1301 bp, Homo sapiens
gagggatgaaaacgataggctaggtacgaggccggtggttaggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgcgcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtcc

SEQ ID NO: 357577 - DNA, 1309 bp, Homo sapiens
agggacagcccagaggaggcgtggccacgctgccggcggaagtggagccctccgcgagcgcgcgaggccgccggggaggcggggaaaccggacagtaggggcggggcgggccggcgatggggatgcgggagcactacgcggagctgcacccgtgcccgccggaattggggatgcagagcagcggcagcgggtatggcaggcaccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtacacttcggggctgcgagcgcggagggcgacgacgacgaagcgcagcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggagtgatgcgaacacccctttttgtgaatgtggtctgggtggcctggggaagccgggttcacag

SEQ ID NO: 357578 - DNA, 331 bp, Homo sapiens
gccttactgagtcatgtttctgactaaaaccgcgttatgaaatggagagaatgacatgtcttgggtttaatcaccacagatgttaactccctgaattttagagttgcagaggaaaaagagcaaaaaccaaaaaaaaaaaatgttcagtaataatgatgtgggtctcataggactccagaaagaacctgccaaagctgcgaactctgcttatttacctaaaacaaatcctaactgtgcaaacaggcacaccctctgatgccacagagcgggaacgccaaggtgggaggaattcagaacaatcacaaggttaacgttccactgagaacacagc

SEQ ID NO: 357579 - DNA, 2400 bp, Homo sapiens
  misc_feature (5)..(5): n is a, c, g, or t
  misc_feature (7)..(7): n is a, c, g, or t
caggncnggtggtgagcagggacggtgcaccggacggcgggatcgagcaaatgggtctggccatggagcacggagggtcctacgctcgggcggggggcagctctcggggctgctggtattacctgcgctacttcttcctcttcgtctccctcatccaattcctcatcatcctggggctcgtgctcttcatggtctatggcaacgtgcacgtgagcacagagtccaacctgcaggccaccgagcgccgagccgagggcctatacagtcagctcctagggctcacggcctcccagtccaacttgaccaaggagctcaacttcaccacccgcgccaaggatgccatcatgcagatgtggctgaatgctcgccgcgacctggaccgcatcaatgccagcttccgccagtgccagggtgaccgggtcatctacacgaacaatcagaggtacatggctgccatcatcttgagtgagaagcaatgcagagatcaattcaaggacatgaacaagagctgcgatggtgagtgctaaggctgcagggagccggggtggtggactccctgcccagtgctctcggcagcccccaatcttcctgggtctcctggtcctgttttccttagccttgctcttcatgctgaatcagaaggtgaagacgctggaggtggagatagccaaggagaagaccatttgcactaaggataaggaaagcgtgctgctgaacaaacgcgtggcggaggaacagctggttgaatgcgtgaaaacccgggagctgcagcaccaagagcgccagctggccaaggagcaactgcaaaaggtgcaagccctctgcctgcccctggacaaggacaagtttgagatggaccttcgtaacctgtggagggactccattatcccacgcagcctggacaacctgggttacaacctctaccatcccctgggctcggaattggcctccatccgcagagcctgcgaccacatgcccagcctcatgagctccaaggtggaggagctggcccggagcctccgggcggatatcgaacgcgtggcccgcgagaactcagacctccaacgccagaagctggaagcccagcagggcctgcgggccagtcaggaggcgaaacagaaggtggagaaggaggctcaggcccgggaggccaagctccaagctgaatgctcccggcagacccagctagcgctggaggagaaggcggtgctgcggaaggaacgagacaacctggccaaggagctggaagagaagaagagggaggcggagcagctcaggatggagctggccatcagaaactcagccctggacacctgcatcaagaccaagtcgcagccgatgatgccagtgtcaaggcccatgggccctgtccccaacccccagcccatcgacccagctagcctggaggagttcaagaggaagatcctggagtcccagaggccccctgcaggcatccctgtagccccatccagtggctgaggaggctccaggcctgaggaccaagggatggcccgactcggcggtttgcggaggatgcagggatatgctcacagcgcccgacacaaccccctcccgccgcccccaaccacccagggccaccatcagacaactccctgcatgcaaacccctagtaccctctcacacccgcacccgcgcctcacgatccctcacccagagcacacggccgcggagatgacgtcacgcaagcaacggcgctgacgtcacatatcaccgtggtgatggcgtcacgtggccatgtagacgtcacgaagagatatagcgatggcgtcgtgcagatgcagcacgtcgcacacagacatggggaacttggcatgacgtcacaccgagatgcagcaacgacgtcacgggccatgtcgacgtcacacatattaatgtcacacagacgcggcgatggcatcacacagacggtgatgatgtcacacacagacacagtgacaacacacaccatgacaacgacacctatagatatggcaccaacatcacatgcacgcatgccctttcacacacactttctacccaattctcacctagtgtcacgttcccccgaccctggcacacgggccaaggtacccacaggatcccatcccctcccgcacagccctgggccccagcacctcccctcctccagcttcctggcctcccagccacttcctcacccccagtgcctggacccggaggtgagaacaggaagccattcacctccgctccttgagcgtgagtgtttccaggaccccctcggggccctgagccgggggtgagggtcacctgttgtcgggaggggagccactccttctcccccaactcccagccctgcctgtggcccgttgaaatgttggtggcacttaataaatattagtaaatccttcaaaaaaaaaagaa

SEQ ID NO: 357580 - DNA, 2307 bp, Homo sapiens
  misc_feature (5)..(5): n is a, c, g, or t
  misc_feature (7)..(7): n is a, c, g, or t
caggncnggtggtgagcagggacggtgcaccggacggcgggatcgagcaaatgggtctggccatggagcacggagggtcctacgctcgggcggggggcagctctcggggctgctggtattacctgcgctacttcttcctcttcgtctccctcatccaattcctcatcatcctggggctcgtgctcttcatggtctatggcaacgtgcacgtgagcacagagtccaacctgcaggccaccgagcgccgagccgagggcctatacagtcagctcctagggctcacggcctcccagtccaacttgaccaaggagctcaacttcaccacccgcgccaaggatgccatcatgcagatgtggctgaatgctcgccgcgacctggaccgcatcaatgccagcttccgccagtgccagggtgaccgggtcatctacacgaacaatcagaggtacatggctgccatcatcttgagtgagaagcaatgcagagatcaattcaaggacatgaacaagagctgcgatgccttgctcttcatgctgaatcagaaggtgaagacgctggaggtggagatagccaaggagaagaccatttgcactaaggataaggaaagcgtgctgctgaacaaacgcgtggcggaggaacagctggttgaatgcgtgaaaacccgggagctgcagcaccaagagcgccagctggccaaggagcaactgcaaaaggtgcaagccctctgcctgcccctggacaaggacaagtttgagatggaccttcgtaacctgtggagggactccattatcccacgcagcctggacaacctgggttacaacctctaccatcccctgggctcggaattggcctccatccgcagagcctgcgaccacatgcccagcctcatgagctccaaggtggaggagctggcccggagcctccgggcggatatcgaacgcgtggcccgcgagaactcagacctccaacgccagaagctggaagcccagcagggcctgcgggccagtcaggaggcgaaacagaaggtggagaaggaggctcaggcccgggaggccaagctccaagctgaatgctcccggcagacccagctagcgctggaggagaaggcggtgctgcggaaggaacgagacaacctggccaaggagctggaagagaagaagagggaggcggagcagctcaggatggagctggccatcagaaactcagccctggacacctgcatcaagaccaagtcgcagccgatgatgccagtgtcaaggcccatgggccctgtccccaacccccagcccatcgacccagctagcctggaggagttcaagaggaagatcctggagtcccagaggccccctgcaggcatccctgtagccccatccagtggctgaggaggctccaggcctgaggaccaagggatggcccgactcggcggtttgcggaggatgcagggatatgctcacagcgcccgacacaaccccctcccgccgcccccaaccacccagggccaccatcagacaactccctgcatgcaaacccctagtaccctctcacacccgcacccgcgcctcacgatccctcacccagagcacacggccgcggagatgacgtcacgcaagcaacggcgctgacgtcacatatcaccgtggtgatggcgtcacgtggccatgtagacgtcacgaagagatatagcgatggcgtcgtgcagatgcagcacgtcgcacacagacatggggaacttggcatgacgtcacaccgagatgcagcaacgacgtcacgggccatgtcgacgtcacacatattaatgtcacacagacgcggcgatggcatcacacagacggtgatgatgtcacacacagacacagtgacaacacacaccatgacaacgacacctatagatatggcaccaacatcacatgcacgcatgccctttcacacacactttctacccaattctcacctagtgtcacgttcccccgaccctggcacacgggccaaggtacccacaggatcccatcccctcccgcacagccctgggcacacacccccatgtccaccatgatcctcttctcacggtgacttgtgctccctcagcaatcatctttcctgttccagacaggtgggcattaggtgtctccatctgagcgtcagtgtcatggtgccctcagctgtacctttatccttccgttattagtcattatgaacgttgagtaatagaattccactctcttctcacttcttgctcatgagaggtgtgatgaggttaattaaagaagaagatgtcctattatttgagagtcgtaattcatggaacgcatg

SEQ ID NO: 357581 - DNA, 727 bp, Homo sapiens
caaggaccatcagtcatcctttaaaattcatttcaagctctgaaaagatattttttgtcacatggccacggtattgatggccatgtagacgtcacgaagagatatagcgatggcgtcgtgcagatgcagcacgtcgcacacagacatggggaacttggcatgacgtcacaccgagatgcagcaacgacgtcacgggccatgtcgacgtcacacatattaatgtcacacagacgcggcgatggcatcacacagacggtgatgatgtcacacacagacacagtgacaacacacaccatgacaacgacacctatagatatggcaccaacatcacatgcacgcatgccctttcacacacactttctacccaattctcacctagtgtcacgttcccccgaccctggcacacgggccaaggtacccacaggatcccatcccctcccgcacagccctgggccccagcacctcccctcctccagcttcctggcctcccagccacttcctcacccccagtgcctggacccggaggtgagaacaggaagccattcacctccgctccttgagcgtgagtgtttccaggaccccctcggggccctgagccgggggtgagggtcacctgttgtcgggaggggagccactccttctcccccaactcccagccctgcctgtggcccgttgaaatgttggtggcacttaataaatattagtaaatccttcaaaaaaaaaagaa

SEQ ID NO: 357582 - DNA, 748 bp, Homo sapiens
  misc_feature (5)..(5): n is a, c, g, or t
  misc_feature (7)..(7): n is a, c, g, or t
caggncnggtggtgagcagggacggtgcaccggacggcgggatcgagcaaatgggtctggccatggagcacggagggtcctacgctcgggcggggggcagctctcggggctgctggtattacctgcgctacttcttcctcttcgtctccctcatccaattcctcatcatcctggggctcgtgctcttcatggtctatggcaacgtgcacgtgagcacagagtccaacctgcaggccaccgagcgccgagccgagggcctatacagtcagctcctagggctcacggcctcccagtccaacttgaccaaggagctcaacttcaccacccgcgccaaggatgccatcatgcagatgtggctgaatgctcgccgcgacctggaccgcatcaatgccagcttccgccagtgccagggtgaccgggtcatctacacgaacaatcagaggtacatggctgccatcatcttgagtgagaagcaatgcagagatcaattcaaggacatgaacaagagctgcgatgccttgctcttcatgctgaatcagaaggtgaagacgaacaggaagccattcacctccgctccttgagcgtgagtgtttccaggaccccctcggggccctgagccgggggtgagggtcacctgttgtcgggaggggagccactccttctcccccaactcccagccctgcctgtggcccgttgaaatgttggtggcacttaataaatattagtaaatccttcaaaaaaaaaagaa

SEQ ID NO: 357583 - DNA, 453 bp, Homo sapiens
gtgatcctcccacctcagcctcccaagtaattgggatgacaggtgtgagctgccacacctggcttctaacattccctcataaagggaccatgcccttgtgaactcagctcactctggccaccagggtgctcgatctgggtccaggcagtcctgggggcaagacactaagctctgtcctgcgtccttcccctatcttccgggcaggtcatctacacgaacaatcagaggtacatggctgccatcatcttgagtgagaagcaatgcagagatcaattcaaggacatgaacaagagctgcgatggtgagtgctaaggctgcagggagccggggtggtggactccctgcccagtgctctcggcagcccccaatcttcctgggtctcctggtcctgttttccttagccttgctcttcatgctgaatcagaaggtgaagacgctggaggtggagatagc

SEQ ID NO: 357584 - DNA, 2300 bp, Homo sapiens
  misc_feature (5)..(5): n is a, c, g, or t
  misc_feature (7)..(7): n is a, c, g, or t
caggncnggtggtgagcagggacggtgcaccggacggcgggatcgagcaaatgggtctggccatggagcacggagggtcctacgctcgggcggggggcagctctcggggctgctggtattacctgcgctacttcttcctcttcgtctccctcatccaattcctcatcatcctggggctcgtgctcttcatggtctatggcaacgtgcacgtgagcacagagtccaacctgcaggccaccgagcgccgagccgagggcctatacagtcagctcctagggctcacggcctcccagtccaacttgaccaaggagctcaacttcaccacccgcgccaaggatgccatcatgcagatgtggctgaatgctcgccgcgacctggaccgcatcaatgccagcttccgccagtgccagggtgaccgggtcatctacacgaacaatcagaggtacatggctgccatcatcttgagtgagaagcaatgcagagatcaattcaaggacatgaacaagagctgcgatgccttgctcttcatgctgaatcagaaggtgaagacgctggaggtggagatagccaaggagaagaccatttgcactaaggataaggaaagcgtgctgctgaacaaacgcgtggcggaggaacagctggttgaatgcgtgaaaacccgggagctgcagcaccaagagcgccagctggccaaggagcaactgcaaaaggtgcaagccctctgcctgcccctggacaaggacaagtttgagatggaccttcgtaacctgtggagggactccattatcccacgcagcctggacaacctgggttacaacctctaccatcccctgggctcggaattggcctccatccgcagagcctgcgaccacatgcccagcctcatgagctccaaggtggaggagctggcccggagcctccgggcggatatcgaacgcgtggcccgcgagaactcagacctccaacgccagaagctggaagcccagcagggcctgcgggccagtcaggaggcgaaacagaaggtggagaaggaggctcaggcccgggaggccaagctccaagctgaatgctcccggcagacccagctagcgctggaggagaaggcggtgctgcggaaggaacgagacaacctggccaaggagctggaagagaagaagagggaggcggagcagctcaggatggagctggccatcagaaactcagccctggacacctgcatcaagaccaagtcgcagccgatgatgccagtgtcaaggcccatgggccctgtccccaacccccagcccatcgacccagctagcctggaggagttcaagaggaagatcctggagtcccagaggccccctgcaggcatccctgtagccccatccagtggctgaggaggctccaggcctgaggaccaagggatggcccgactcggcggtttgcggaggatgcagggatatgctcacagcgcccgacacaaccccctcccgccgcccccaaccacccagggccaccatcagacaactccctgcatgcaaacccctagtaccctctcacacccgcacccgcgcctcacgatccctcacccagagcacacggccgcggagatgacgtcacgcaagcaacggcgctgacgtcacatatcaccgtggtgatggcgtcacgtggccatgtagacgtcacgaagagatatagcgatggcgtcgtgcagatgcagcacgtcgcacacagacatggggaacttggcatgacgtcacaccgagatgcagcaacgacgtcacgggccatgtcgacgtcacacatattaatgtcacacagacgcggcgatggcatcacacagacggtgatgatgtcacacacagacacagtgacaacacacaccatgacaacgacacctatagatatggcaccaacatcacatgcacgcatgccctttcacacacactttctacccaattctcacctagtgtcacgttcccccgaccctggcacacgggccaaggtacccacaggatcccatcccctcccgcacagccctgggccccagcacctcccctcctccagcttcctggcctcccagccacttcctcacccccagtgcctggacccggaggtgagaacaggaagccattcacctccgctccttgagcgtgagtgtttccaggaccccctcggggccctgagccgggggtgagggtcacctgttgtcgggaggggagccactccttctcccccaactcccagccctgcctgtggcccgttgaaatgttggtggcacttaataaatattagtaaatccttcaaaaaaaaaagaa

SEQ ID NO: 357585 - DNA, 822 bp, Homo sapiens
tattgagtggccatgtgacaggaattccttcttttttaaggctgcataatattctattttatgtgtatggcacattttctttacccattcatccattcatgggttgcttctctcttgtggctattgtgaattaagctgcgtgaacatgagtgtgcaaatatctctgtattgatggccatgtagacgtcacgaagagatatagcgatggcgtcgtgcagatgcagcacgtcgcacacagacatggggaacttggcatgacgtcacaccgagatgcagcaacgacgtcacgggccatgtcgacgtcacacatattaatgtcacacagacgcggcgatggcatcacacagacggtgatgatgtcacacacagacacagtgacaacacacaccatgacaacgacacctatagatatggcaccaacatcacatgcacgcatgccctttcacacacactttctacccaattctcacctagtgtcacgttcccccgaccctggcacacgggccaaggtacccacaggatcccatcccctcccgcacagccctgggccccagcacctcccctcctccagcttcctggcctcccagccacttcctcacccccagtgcctggacccggaggtgagaacaggaagccattcacctccgctccttgagcgtgagtgtttccaggaccccctcggggccctgagccgggggtgagggtcacctgttgtcgggaggggagccactccttctcccccaactcccagccctgcctgtggcccgttgaaatgttggtggcacttaataaatattagtaaatccttcaaaaaaaaaagaa

SEQ ID NO: 357586 - DNA, 1335 bp, Homo sapiens
  misc_feature (5)..(5): n is a, c, g, or t
  misc_feature (7)..(7): n is a, c, g, or t
caggncnggtggtgagcagggacggtgcaccggacggcgggatcgagcaaatgggtctggccatggagcacggagggtcctacgctcgggcggggggcagctctcggggctgctggtattacctgcgctacttcttcctcttcgtctccctcatccaattcctcatcatcctggggctcgtgctcttcatggtctatggcaacgtgcacgtgagcacagagtccaacctgcaggccaccgagcgccgagccgagggcctatacagtcagctcctagggctcacggcctcccagtccaacttgaccaaggagctcaacttcaccacccgcgccaaggatgccatcatgcagatgtggctgaatgctcgccgcgacctggaccgcatcaatgccagcttccgccagtgccagggtgaccgggtcatctacacgaacaatcagaggtacatggctgccatcatcttgagtgagaagcaatgcagagatcaattcaaggacatgaacaagagctgcgatgccttgctcttcatgctgaatcagaaggtgaagacgctggaggtggagatagccaaggagaagaccatttgcactaaggataaggaaagcgtgctgctgaacaaacgcgtggcggaggaacagctggttgaatgcgtgaaaacccgggagctgcagcaccaagagcgccagctggccaaggagcaactgcaaaaggtgcaagccctctgcctgcccctggacaaggacaagtttgagatggaccttcgtaacctgtggagggactccattatcccacgcagcctggacaacctgggttacaacctctaccatcccctgggctcggaattggcctccatccgcagagcctgcgaccacatgcccagcctcatgagctccaaggtggaggagctggcccggagcctccgggcggatatcgaacgcgtggcccgcgagaactcagacctccaacgccagaagctggaagcccagcagggcctgcgggccagtcaggaggcgaaacagaaggtggagaaggaggctcaggcccgggaggccaagctccaagctgaatgctcccggcagacccagttcctggcctcccagccacttcctcacccccagtgcctggacccggaggtgagaacaggaagccattcacctccgctccttgagcgtgagtgtttccaggaccccctcggggccctgagccgggggtgagggtcacctgttgtcgggaggggagccactccttctcccccaactcccagccctgcctgtggcccgttgaaatgttggtggcacttaataaatattagtaaatccttcaaaaaaaaaagaa

SEQ ID NO: 357587 - DNA, 410 bp, Homo sapiens
taccaattcacatggaggaccttattgtttggtccaataatcagagatttgaaagaacctgatattgttggccagcagattagaaaagagttattagagagagatggctcaagtgataataactgtatgccttgtgaatgctcacctaaaccaaagatcactgaagataatgtattttaccataatgttttaatctcaggtaaatgccaatcaggagacaaacacttctttatctcctgattggtattgatctgaattaagctgtctgccatttggagaaatttaaatgctattttaaacacacagtcttgttacttgagttatttatgatcttaagcggctcccctccttttgtgggttagattgtgtcttcaaaaagaaaatatatatattagagttctagcccctga

SEQ ID NO: 357588 - DNA, 598 bp, Homo sapiens
actagattagtcctaattaatttagtctacttagtttaactaatcggtaactgccttagtctgttttgtgttgctataacagaatacttgagtctgggtaacttgtagagaaaaggggtttacttggcttatgattctggtggctagatagtctaagattggaaagctgaatctggtaagggtctcaggctgcttccattcatggtggagagtggcaagggagtgggcaggtgcagaggaatcagatggtgagagagaaagtaggggagagaaactgaagaaaccagactttttaacagcccactgttgtgggaattaatttactcctaccagactctgattatcctttttaatttaggtgaaggatgctaccccaacaggatagcattaatttattcatgaaaaatccacccctcggacccaaacacctcccactagtctccagcttccatcatggccacactggggaccaaatttcaacatgagttttgatggggacaaaccacatccagaccatagtagtaaccagcattgatttacctcctactcgcagtcatttggtggctgcaaaaatgtattaagcaagcctctgctctca

SEQ ID NO: 357589 - DNA, 1128 bp, Homo sapiens
cgtctccctcgcagtcccgcccgcccctcctgccgcccctgccgcgcgcgccgcagcagcgccgccttccctgcggagtcggtgtctccgcgtcgctgggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagcacgtcttccgcacctttgacaccaacagcgatggcaccatagactttcgggagttcatcattgcgctgagcgtgacctcgcgcggccgcctggagcagaagctcatgtgggccttcagcatgtatgacctggacggcaacggctacatcagccgggaggagatgctggagatcgtgcaggccatttacaagatggtttcgtccgtgatgaagatgccggaggacgagtcgaccccggaaaagaggactgagaaaatcttccgccaaatggacacaaacaacgacggcaagctgtccttggaggagttcatccgcggggccaaaagcgacccgtccatcgtgcgtctgctgcagtgcgaccccagcagcgcctcccagttctgagaggagccaggttccccttcctccctcccttcaccggccccctcccggctcttagcttccactcccttgtgtgtattctggctgggggccagattggggaagcccttctccccgggtctgccctgtggggggcttccggaaaagggaaccctgcggtacccccaggccaaagcaagtaagcggttagcaccccccaatcccagaggcaacaatagagacacaggctgggttggtctgcccctcagtcaggcccccttacccacccaccagccccaaggcccgacccctcccccaaaggggcagtccccttcttgcaggtctcagcttgcggggtggggggagtcatgccctgcatgcagccaaatggagcatctctgttctttttaataatttcagaataaagtctcatttcagtgcagtgggctg

SEQ ID NO: 357590 - DNA, 1494 bp, Homo sapiens
cgtctccctcgcagtcccgcccgcccctcctgccgcccctgccgcgcgcgccgcagcagcgccgccttccctgcggagtcggtgtctccgcgtcgctgggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagcacgtcttccgcacctttgacaccaacagcgatggcaccatagactttcgggagttcatcattgcgctgagcgtgacctcgcgcggccgcctggagcagaagctcatgtgggccttcagcatgtatgacctggacggcaacggctacatcagccgggaggagatgctggagatcgtgcaggccatttacaagatggtttcgtccgtgatgaagatgccggaggacgagtcgaccccggaaaagaggactgagaaaatcttccgccaaatggacacaaacaacgacggcaagctgtccttggaggagttcatccgcggggccaaaagcgacccgtccatcgtgcgtctgctgcagtgcgaccccagcagcgcctcccagttctgagaggagccaggttccccttcctccctcccttcaccggccccctcccggctcttagcttccactcccttgtgtgtattctggctgggggccagattggggaagcccttctccccgggtctgccctgtggggggcttccggaaaagggaaccctgcggtacccccaggccaaagcaagtaagcggttagcaccccccaatcccagaggcaacaatagagacacaggctgggttggtctgcccctcagtcaggcccccttacccacccaccagccccaaggcccgacccctcccccaaaggggcagtccccttcttgcaggtctcagcttgcggggtggggggagtcatgcccaggggaggagactttttatctggaggggagagaaggattctaggggtgtggagttggagaaagaggcttccttgagccacccttcccaccccagcccttgctggtccctaggccaagccaccaagtgaaaccttccaggatactagcccgccagctgtgggccccagaaagccagcctgccttttagcacttggatacacacagacccacggagctctctgtgtttggcctctcacacacacacaggcccatagacagatgggcagatgcacccagagccccatgcacagtgtcctgcgtgggaaagagacacggtccccctggctgagcccctgtcctcccctctgtccccccaaccgccccccctgcatgcagccaaatggagcatctctgttctttttaataatttcagaataaagtctcatttcagtgcagtgggctg

SEQ ID NO: 357591 - DNA, 877 bp, Homo sapiens
cgtctccctcgcagtcccgcccgcccctcctgccgcccctgccgcgcgcgccgcagcagcgccgccttccctgcggagtcggtgtctccgcgtcgctgggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagcacgtcttccgcacctttgacaccaacagcgatggcaccatagactttcgggagttcatcattgcgctgagcgtgacctcgcgcggccgcctggagcagaagctcatgtgggccttcagcatgtatgacctggacggcaacggctacatcagccgggaggagatgctggagatcgtgcagagcacagtccagctatgtctagttgatcctcatttacaccagaggaaacggatgctcagagagataaaggcacttgcttgaggccacacagcctgtgtgagtgggccatctggcaccactgtctacattccatctggatacccagccatcttctaactaattgattgagggcccactatgagcctagcattgagtgaggtgctcatgagctcagtgcgtgcttacaacaaccccatgaggctcagagaggtgaggtgatgtgcccaaaatcacacagcacataagtggagaaaagctctggctggccactacttagagctgtctactgagagggctctggactcatagccaggaggtctggcttccagttctggaagtg

SEQ ID NO: 357592 - DNA, 1438 bp, Homo sapiens
gcctgatcactcctctctgcccttgacccccttggggacccaggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagcacgtcttccgcacctttgacaccaacagcgatggcaccatagactttcgggagttcatcattgcgctgagcgtgacctcgcgcggccgcctggagcagaagctcatgtgggccttcagcatgtatgacctggacggcaacggctacatcagccgggaggagatgctggagatcgtgcaggccatttacaagatggtttcgtccgtgatgaagatgccggaggacgagtcgaccccggaaaagaggactgagaaaatcttccgccaaatggacacaaacaacgacggcaagctgtccttggaggagttcatccgcggggccaaaagcgacccgtccatcgtgcgtctgctgcagtgcgaccccagcagcgcctcccagttctgagaggagccaggttccccttcctccctcccttcaccggccccctcccggctcttagcttccactcccttgtgtgtattctggctgggggccagattggggaagcccttctccccgggtctgccctgtggggggcttccggaaaagggaaccctgcggtacccccaggccaaagcaagtaagcggttagcaccccccaatcccagaggcaacaatagagacacaggctgggttggtctgcccctcagtcaggcccccttacccacccaccagccccaaggcccgacccctcccccaaaggggcagtccccttcttgcaggtctcagcttgcggggtggggggagtcatgcccaggggaggagactttttatctggaggggagagaaggattctaggggtgtggagttggagaaagaggcttccttgagccacccttcccaccccagcccttgctggtccctaggccaagccaccaagtgaaaccttccaggatactagcccgccagctgtgggccccagaaagccagcctgccttttagcacttggatacacacagacccacggagctctctgtgtttggcctctcacacacacacaggcccatagacagatgggcagatgcacccagagccccatgcacagtgtcctgcgtgggaaagagacacggtccccctggctgagcccctgtcctcccctctgtccccccaaccgccccccctgcatgcagccaaatggagcatctctgttctttttaataatttcagaataaagtctcatttcagtgcagtgggctg

SEQ ID NO: 357593 - DNA, 1095 bp, Homo sapiens
cgtctccctcgcagtcccgcccgcccctcctgccgcccctgccgcgcgcgccgcagcagcgccgccttccctgcggagtcggtgtctccgcgtcgctgggccatttacaagatggtttcgtccgtgatgaagatgccggaggacgagtcgaccccggaaaagaggactgagaaaatcttccgccaaatggacacaaacaacgacggcaagctgtccttggaggagttcatccgcggggccaaaagcgacccgtccatcgtgcgtctgctgcagtgcgaccccagcagcgcctcccagttctgagaggagccaggttccccttcctccctcccttcaccggccccctcccggctcttagcttccactcccttgtgtgtattctggctgggggccagattggggaagcccttctccccgggtctgccctgtggggggcttccggaaaagggaaccctgcggtacccccaggccaaagcaagtaagcggttagcaccccccaatcccagaggcaacaatagagacacaggctgggttggtctgcccctcagtcaggcccccttacccacccaccagccccaaggcccgacccctcccccaaaggggcagtccccttcttgcaggtctcagcttgcggggtggggggagtcatgcccaggggaggagactttttatctggaggggagagaaggattctaggggtgtggagttggagaaagaggcttccttgagccacccttcccaccccagcccttgctggtccctaggccaagccaccaagtgaaaccttccaggatactagcccgccagctgtgggccccagaaagccagcctgccttttagcacttggatacacacagacccacggagctctctgtgtttggcctctcacacacacacaggcccatagacagatgggcagatgcacccagagccccatgcacagtgtcctgcgtgggaaagagacacggtccccctggctgagcccctgtcctcccctctgtccccccaaccgccccccctgcatgcagccaaatggagcatctctgttctttttaataatttcagaataaagtctcatttcagtgcagtgggctg

SEQ ID NO: 357594 - DNA, 1026 bp, Homo sapiens
gagacggggtcttgctctgtcacccaggctggagggcagtggcacaatcacagccactgcagccttgactcctgggctcaagcaatcctcctgccttggcctcccaaagtgttagggttagagatatgaaccaccacacccaccttatatgtccttttatttcataaaaaacaattttagattatctgatatcacacatatcccataaatggtagtcattaatttagaagtgaatttataaagttaagagaagttaaaattgcacatgcattttgtttctaaaatctgagatgtctatgcatttccaggtattgtatatttgcaaatacattgggttagaaatcatctttaacattttgtgttagtgtaataacaatattatctaatattaatgctgccagaatccagttgctttttctgtgtatcaaaatttatcataactttttccacttaacactaggtaattaaacagaatctgcccaatttattctgcagtaaaattattttaaaatctatttttcctgctgactcttagaaattgcagaaagacaaaaaccagtttcatctccagtaatagtgtgaaacaatttccttccagtgggacagaaacctagacatactagggaaagatttaaatataaagaaaaatgccttggctgaaaaaaaaaaaaaccaccaaaacacaaaaaggattcattaaagcaacagaacaaaacctaatttgggaccctaaaaactctggcaatgccactgtaatgaagtttcattatctgcttcagagtaacagtctctgaaattgttattctgctacatgctgtaaagaactcccaaaactcaaatgtatcaggaaatgtaaaggttaagtctgactacaagaaggccaaaattgcaccagcttcctaagtgaagaataatagaataaaacatatagagggcagaaataaaatgaggtgtatctggagaatttcatgatgagcatttagatttagcaatgcccaatgtcatgctgacactgtttgtcatgac

SEQ ID NO: 357595 - DNA, 121 bp, Homo sapiens
cttcttaataaagacataataaaacttacatatatggggtagatgtaagcacaatcatactacagatgtatcttgagcctgtctctaattatgatgaaagatgtagtcatcaatacaattt

SEQ ID NO: 357596 - DNA, 882 bp, Homo sapiens
ataaagacataataaaacttacatatatggggtagatgtaagcacaatcatactacagatgtatcttgagcctgtctctaattatgatgaaagatgtagtcatcaatacaatttaaaaaaagatatgtcctttttttgagacggggtcttgctctgtcacccaggctggagggcagtggcacaatcacagccactgcagccttgacctctccaacttaagtgatctttcctgcctcagcctcatgagtagctgggaccacaggtgtgcaccaccacacccagctaaattttgtattgtttgtaaagacgaggcctcactatgctgaccacactggtctcgaactcctgggctcaagcaatcctcctgccttggcctcccaaagtgttagggttagagatatgaaccaccacacccaccttatatgtccttttatttcataaaaaacaattttagattatctgatatcacacatatcccataaatggtagtcattaatttagaagtgaatttataaagttaagagaagttaaaattgcacatgcattttgtttctaaaatctgagatgtctatgcatttccaggtattgtatatttgcaaatacattgggttagaaatcatctttaacattttgtgttagtgtaataacaatattatctaatattaatgctgccagaatccagttgctttttctgtgtatcaaaatttatcataactttttccacttaacactaggtaattaaacagaatctgcccaatttattctgcagtaaaattattttaaaatctatttttcctgctgactcttagaaattgcagaaagacaaaaaccagtttcatctccagtaatagtgtgaaacaatttccttccagtgggacagaa

SEQ ID NO: 357597 - DNA, 332 bp, Homo sapiens
aagaaatgtttgaagaaataacgcctgaaaacattccaaacttgatgaaaactataaacccacagatccaaacaccatggcaaaccccaagcacaagaaacatgaagaaaacaataccaagctacatcataatcaaactgcttagaacctatgacaaagagaaaatctgagaaacagaccaaaaaaaaacaaaaaaaaaaagaaagaaattgggagacagaggtaggagaattgcttgaccctggtaggtggaggttggagtgagccaagacatcatgccaccgcactccagcctgggtgacagagcgagactccatctcaaaaaaaaaaaa

SEQ ID NO: 357598 - DNA, 1077 bp, Homo sapiens
agcagtctttgaaacagctgtaacggcatctgtgaaagaagataggttccaggaacggaactgccacttagattgtaaattcctgaaaaacaggacgtttttgcatctcctcccggcttccccatccctaaaccaacgtctgttgaattaaactaccaaacaaaataactgcagtacagcaatggcgatcagaaggtagaacagctgtatggctgcacattcccatcctccaaagccgatttattgcccctgctgcttccctgggcttctgctttcaccacgcagaatcggattcatcaacgttgactctgtggctgagagaagggcccagcagattaccaggatatgcttcacatcaagtaggagttgcaggagctgtatttgatgaaagtactagaaaaatactggttgtacaagatcgaaataaattgaaaaatatgtggaagtttccaggaggcctgtcagagcctgaagaagatattggagacacagcggttcgagaagtttttgaagagactggtataaaatcagaattcaggtccgtcctgagtattcggcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgtgattttctaatgtatatgatttccatgaagaaattttgtttctaaacatgcacattttaaaagcctcttttcgaataaagcaaatgcgtgaaaaagatcattgctctag

SEQ ID NO: 357599 - DNA, 666 bp, Homo sapiens
acaaactaatcaattttattcatactactcatgaaaagcaattacatttttacataaaatcattaacacatacaatagaaataataagagtaatacatctgattagaaatacaatataggaaatagattttaaaatagcatattttagtgatgaaatttatattttctacttatttatagcagcatctgtaagattcttctatctgttcatagttaactagcagcaaaatattttaaattacagaaattcagtagatgtttccctccaatgtttcattcatacagaatgtatcacgttaaccaaacaaaaccacttatatttcctgaagagaaaaggtgggaaaagatttcatcagttaccagctcccccaaaaaaagaagaaacgagggagaaaggatggaagctagaaaaattttgcatgcaattactaaaaaatatattctcaaccactttgaccaattataggtggattttgtgaaatctacatatgtgtgtgttagtgaaagttatgttaactttattttctgactttatactgcagttgaaaaatatgtggaagtttccaggaggcctgtcagagcctgaagaagatattggtgtgtatcttttatatttttaattggcttaaaaatgttgaggaaattaatgtgtttactttcttgctt

SEQ ID NO: 357600 - DNA, 624 bp, Homo sapiens
gcattcaaatggtatttgattcggtttaaatccttttatttgtccactctaaaactacagaacatctgttacgtgccaagcattgtctttggtggtatggatataaaggtcagcagtgtaatgactttattctgaaggaattcagtctgatggaaaaatcatataaacaaggtggttactataaaacatggtacttccagtgccagcgatgtgaacaagacatttggggacctcttttgcttaaagatggtttcctggaggaggcgaaaccctgaggtgagttttaatttattccactcgtctctttggaaattatttagacttttttcttctgcatttagctgcagtacagcaatggcgatcagaaggtagaacagctgtatggctgcacattcccatcctccaaagccgatttattgcccctgctgcttccctgggcttctgctttcaccacgcagaatcggattcatcaacgttgactctgtggctgagagaagggcccagcagattaccaggatatgcttcacatcaagtaggagttgcaggagctgtatttgatgaaagtactagaaaaatactggttgtacaagatcgaaataaagtaagctgcttctgttttataaa

SEQ ID NO: 357601 - DNA, 555 bp, Homo sapiens
catttgggcaacggacgaatcaagcggcgtggagatgcggcagccgctgagctggggccgctggcgcgcgatgcttgcccgaacctacggccccgggccttcggcgggttaccgctgggcctcgggcgcacagggttacgtgcggaatccgccagttggagcgtgcgatctgcagggcgagctggacagattcgggggcatctcggtgcgcctggcgcggctcgatgcgctggaccgcctggacgctgccgccttccagaagggcttgcaggctgcagtacagcaatggcgatcagaaggtagaacagctgtatggctgcacattcccatcctccaaagccgatttattgcccctgctgcttccctgggcttctgctttcaccacgcagaatcggattcatcaacgttgactctgtggctgagagaagggcccagcagattaccaggatatgcttcacatcaagtaggagttgcaggagctgtatttgatgaaagtactagaaaaatactggttgtacaagatcgaaataaagtaagctgcttctgttttataaa

SEQ ID NO: 357602 - DNA, 684 bp, Homo sapiens
  misc_feature (6)..(6): n is a, c, g, or t
  misc_feature (23)..(23): n is a, c, g, or t
  misc_feature (28)..(28): n is a, c, g, or t
  misc_feature (33)..(33): n is a, c, g, or t
tcgtangtgactgactctctttntaacnccgcnagttgaaaaatatgtggaagtttccaggaggcctgtcagagcctgaagaagatattggagacacagcggttcgagaagtttttgaagagactggtataaaatcagaattcaggtccgtcctgagtattcggcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgtgattttctaatgtatatgatttccatgaagaaattttgtttctaaacatgcacattttaaaagcctcttttcgaataaagcaaatgcgtgaaaaagatcattgctctag

SEQ ID NO: 357603 - DNA, 1181 bp, Homo sapiens
catttgggcaacggacgaatcaagcggcgtggagatgcggcagccgctgagctggggccgctggcgcgcgatgcttgcccgaacctacggccccgggccttcggcgggttaccgctgggcctcgggcgcacagggttacgtgcggaatccgccagttggagcgtgcgatctgcagggcgagctggacagattcgggggcatctcggtgcgcctggcgcggctcgatgcgctggaccgcctggacgctgccgccttccagaagggcttgcaggctgcagtacagcaatggcgatcagaaggtagaacagctgtatggctgcacattcccatcctccaaagccgatttattgcccctgctgcttccctgggcttctgctttcaccacgcagaatcggattcatcaacgttgactctgtggctgagagaagggcccagcagattaccaggatatgcttcacatcaagtaggagttgcaggagctgtatttgatgaaagtactagaaaaatactggttgtacaagatcgaaataaattgaaaaatatgtggaagtttccaggaggcctgtcagagcctgaagaagatattggagacacagcggttcgagaagtttttgaagagactggtataaaatcagaattcaggtccgtcctgagtattcggcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgtgattttctaatgtatatgatttccatgaagaaattttgtttctaaacatgcacattttaaaagcctcttttcgaataaagcaaatgcgtgaaaaagatcattgctctag

SEQ ID NO: 357604 - DNA, 788 bp, Homo sapiens
aggcatcgtctgtaaagaatgagcccttattagacactgaatctgccagcaccttgatcttggacttcctagcttctagaactgagctgtatttgatgaaagtactagaaaaatactggttgtacaagatcgaaataaattgaaaaatatgtggaagtttccaggaggcctgtcagagcctgaagaagatattggagacacagcggttcgagaagtttttgaagagactggtataaaatcagaattcaggtccgtcctgagtattcggcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgtgattttctaatgtatatgatttccatgaagaaattttgtttctaaacatgcacattttaaaagcctcttttcgaataaagcaaatgcgtgaaaaagatcattgctctag

SEQ ID NO: 357605 - DNA, 1556 bp, Homo sapiens
catttgggcaacggacgaatcaagcggcgtggagatgcggcagccgctgagctggggccgctggcgcgcgatgcttgcccgaacctacggccccgggccttcggcgggttaccgctgggcctcgggcgcacagggttacgtgcggaatccgccagttggagcgtgcgatctgcagggcgagctggacagattcgggggcatctcggtgcgcctggcgcggctcgatgcgctggaccgcctggacgctgccgccttccagaagggcttgcaggctgcagtacagcaatggcgatcagaaggtagaacagctgtatggctgcacattcccatcctccaaagccgatttattgcccctgctgcttccctgggcttctgctttcaccacgcagaatcggattcatcaacgttgactctgtggctgagagaagggcccagcagattaccaggatatgcttcacatcaagtaggagttgcaggagctgtatttgatgaaagtactagaaaaatactggttgtacaagatcgaaataaattgaaaaatatgtggaagtttccaggaggcctgtcagagcctgaagaagatattggagacacagcggttcgagaagtttttgaagagactggtataaaatcagaattcaggtccgtcctgagtattcggcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgtgattttctaatgtatatgatttccatgaagaaattttgtttctaaacatgcacattttaaaagcctcttttcgaataaagcaaatgcgtgaaaaagatcattgctctaggtttatgatcaagaatagaagcagaagggaaacaaagagtgaaaggaaaattcatagtaaccataaagacaacatgaaaggtcaccatggaacttcatagactgattccccagaggcatctaagacacatcaatgaacaaaactgaacaagatccctgcctttatgccactcaaattctagctgggggagacacacaataagcaataagcttaagtgaataaattatattctatgttagaatataagaaaacttagaaaaatgtaaacctgaacagggtaagagggactaggaatggtgagtggtagaagctaggtgcaatattaaatagcatggtcacagtaggctccattgagaaagtgacatttgagcaaat

SEQ ID NO: 357606 - DNA, 474 bp, Homo sapiens
atgaagttctggggtacaagtcactaatgtattagaaattttccagctctccctccttgcccagcagagtatatttccactcaaacacaatgaacccatttggaatgggacaaaacaaaatggggtgggcctggaacaagagaaagttcagctacacaggatccaggtcaaaactctttaatcctcccatttctggatttcaaatgaacacctttttgtctagcagttctcctccagaggtttgctttcccacaacagcttgtcaacagtgtaagaagttcaaaaagaacttttggggttgcacgttgcaggttgtgtggcatcatcccagcttgtctcaacacctctgatgaacagtagcggaagaaaggactctttccacatgagttcctcggcggtccccgtctcttagggagtttataaaaaaatccatcatcttgttctactaaacccaagtaaatataattaacacca

SEQ ID NO: 357607 - DNA, 1258 bp, Homo sapiens
tctgctctgagcccccgcccagcccagaaaccccactagcctggggcctgagaacagccacgccactccctcctgagagcccaccgcgccacagcttggaggaagagcctgcggggaactggctgcaggacgctctcttcttgagtgcagcctgctcctgcaaccagcacgcccgacgctgccggttcaactctgagctgttcagactgtcgggcggccggagtgggggtgtttgtgagcggtgccgccaccacacagctgggcggcactgccactactgccaacctgggttctggagggaccctagccagcctatcttcagccgcagggcctgcagagcctgccagtgccaccctattggggcaacaggaggaacctgcaaccagaccagtgggcagtgcacctgcaagttaggggtcacaggcctgacctgcaaccgctgtggccctggctaccagcagagccgctcccccaggatgccctgccagcgaattccagaggcaacaaccacccttgccactactcctggtgcttatagctctgaccctcagtgtcaaaactactgcaatatgtcggacaccagggtacacatgagccttcggaggtactgccagcaggaccatgttctccgcgcgcaggtgctagcgtccgaggcggcgggcccggcatggcagcggctggccgtgcgcgtgctggccgtttacaagcagcgggcgcagcccgtgcgacgcggcgaccaggacgcctgggtgccccgcgccgacctgacctgcggctgcctgcgcctgcagccaggcaccgactacctgctgctgggcagcgccgtgggcgaccccgaccccacgcgcctcatcctcgaccgccacggcctcgcgctgccatggaggccgcgctgggcccggcccctgaagcggctgcagcaggaggagcgcgccggaggctgccgcggcgtgcgggcacccacacccagtcccaggccggagcactagacgtgagatggggctgcctcgagcaccaacaaagtaatttgggagcgactaggagctgagccttctacctcgacggtgcactgcagagagccaatcagacgtcgcagagccccgacgacactatgcttgcgcccacgccgagcaggcgtgcggaacttttagcaaaaggcggcaagcgggacttctggtcccaacatttcctcctttggcctgtggcttattccccgccagtgatctgtttcccccaataaagtctcaaatctttggga

SEQ ID NO: 357608 - DNA, 1603 bp, Homo sapiens
tctgctctgagcccccgcccagcccagaaaccccactagcctggggcctgagaacagccacgccactccctcctgagagcccaccgcgccacagcttggaggaagagcctgcggggaactggctgcaggacgctctcttcttgagtgcagcctgctcctgcaaccagcacgcccgacgctgccggttcaactctgagctgttcagactgtcgggcggccggagtgggggtgtttgtgagcggtgccgccaccacacagctgggcggcactgccactactgccaacctgggttctggagggaccctagccagcctatcttcagccgcagggcctgcagagcctgccagtgccaccctattggggcaacaggaggaacctgcaaccagaccagtgggcagtgcacctgcaagttaggggtcacaggcctgacctgcaaccgctgtggccctggctaccagcagagccgctcccccaggatgccctgccagcgaattccagaggcaacaaccacccttgccactactcctggtgcttatagctctgaccctcagtgtcaaaactactgcaatatgtcggacaccagggtacacatgagccttcggaggtactgccagcaggaccatggtgagtgctggggagacagacagctgaaggctacacagctggttctgatgactgcttctaagccaccccctttctggccttccactttctcatcttaaatgggaaggagtgttggattccaaaccccttcctgatctagaaattgatggggcagaagacaaatggggaggggagtggggagggggcattcactaccttcctgtgtctcctctttccccatgttcttcggcttacagagtttcatcatctccttcagcctgacatctctgagggatggaagagataggggaactggttgagtggaatgaactcttgccctgtcctccctatctcagagaccctttctgcttcccttcatggtcccagatatttgagccttagccccacttcccataaagacttgtcccacggttccctaatccccagtccacacctgctccatgaccttggggtctatgacctcaggctattcagctctcttaagacactcaggagttcggcccagccaacaaatctagaccaacgccagctatttctctcaatgtataggaccgcagacttctccctcaggaacctcatctggtcactagtgttctaggccttcacaggtggaaagattttccccaccttccacagggatctcctgccccgcagacccagctggctagtcagagtcccacccagcctctcagaaagtgcatttttctggccgggcgcggtggctcatgctaataatcccagcactttgtgggggccgaggtgggcggatcacttgaggtcaggagttcgagaccagcctggccaacatggtgaaactccatctctactaaaaatacaaaaattagccaggcgtggtggcaggatcctgtaaacccagctgaggcacaagaatcacttcaacctgggaggcagaggctgcagtgagttgagatcacaccactgcactccagactgggcaatagagtaagattccgtctca

SEQ ID NO: 357609 - DNA, 2220 bp, Homo sapiens
ggcctggtggcgaattcggcacgaggcagccacgccactccctcctgagagcccaccgcgccacagcttggaggaagagcctgcggggaactggctgcaggacgctctcttcttgagtgcaggtgctggctctgctgtgaccatgcccgtgacctttgccctcctgctcctcctgggccaggccactgcggacccatgctacgatccacagggccgcccccaattctgcctcccgccagtgacacagctggctgccgtggcggcctcctgccctcaggcctgtgccctgtccccaggaaaccaccttggcgccagggaaacctgcaatggcagcctgactttggccctgggtggccccttcctcctgacatctgtcagcttgcgcttctgtaccccaggacccccagccctcatcctgtctgctgcctgggcctcagggggtccctggaggctgctgtggcacaggcccgcctggcctggggccttagggggccctgaaagggtgaccttccactccacaccaggtcctaaggccactgtggcggccagccacctccgtgtggagtttgggggccaggccgggctagcggcagctgggctgagaggccgctgccagtgtcatggccacgctgcccgctgtgccgcccgtgcccggcccccccgctgcactgccgccacataccactggcccggggtgcgagagcttgccgccgtcccatcgagactggccctggcggctgcacgccccggaccccaaccttgcctaccctgctcctgcaaccagcacgcccgacgctgccggttcaactctgagctgttcagactgtcgggcggccggagtgggggtgtttgtgagcggtgccgccaccacacagctgggcggcactgccactactgccaacctgggttctggagggaccctagccagcctatcttcagccgcagggcctgcagagcctgccagtgccaccctattggggcaacaggaggaacctgcaaccagaccagtgggcagtgcacctgcaagttaggggtcacaggcctgacctgcaaccgctgtggccctggctaccagcagagccgctcccccaggatgccctgccagcgaattccagaggcaacaaccacccttgccactactcctggtgcttatagctctgaccctcagtgtcaaaactactgcaatatgtcggacaccagggtacacatgagccttcggaggtactgccagcaggaccatggtgagtgctggggagacagacagctgaaggctacacagctggttctgatgactgcttctaagccaccccctttctggccttccactttctcatcttaaatgggaaggagtgttggattccaaaccccttcctgatctagaaattgatggggcagaagacaaatggggaggggagtggggagggggcattcactaccttcctgtgtctcctctttccccatgttcttcggcttacagagtttcatcatctccttcagcctgacatctctgagggatggaagagataggggaactggttgagtggaatgaactcttgccctgtcctccctatctcagagaccctttctgcttcccttcatggtcccagatatttgagccttagccccacttcccataaagacttgtcccacggttccctaatccccagtccacacctgctccatgaccttggggtctatgacctcaggctattcagctctcttaagacactcaggagttcggcccagccaacaaatctagaccaacgccagctatttctctcaatgtataggaccgcagacttctccctcaggaacctcatctggtcactagtgttctaggccttcacaggtggaaagattttccccaccttccacagggatctcctgccccgcagacccagctggctagtcagagtcccacccagcctctcagaaagtgcatttttctggccgggcgcggtggctcatgctaataatcccagcactttgtgggggccgaggtgggcggatcacttgaggtcaggagttcgagaccagcctggccaacatggtgaaactccatctctactaaaaatacaaaaattagccaggcgtggtggcaggatcctgtaaacccagctgaggcacaagaatcacttcaacctgggaggcagaggctgcagtgagttgagatcacaccactgcactccagactgggcaatagagtaagattccgtctca

SEQ ID NO: 357610 - DNA, 1875 bp, Homo sapiens
ggcctggtggcgaattcggcacgaggcagccacgccactccctcctgagagcccaccgcgccacagcttggaggaagagcctgcggggaactggctgcaggacgctctcttcttgagtgcaggtgctggctctgctgtgaccatgcccgtgacctttgccctcctgctcctcctgggccaggccactgcggacccatgctacgatccacagggccgcccccaattctgcctcccgccagtgacacagctggctgccgtggcggcctcctgccctcaggcctgtgccctgtccccaggaaaccaccttggcgccagggaaacctgcaatggcagcctgactttggccctgggtggccccttcctcctgacatctgtcagcttgcgcttctgtaccccaggacccccagccctcatcctgtctgctgcctgggcctcagggggtccctggaggctgctgtggcacaggcccgcctggcctggggccttagggggccctgaaagggtgaccttccactccacaccaggtcctaaggccactgtggcggccagccacctccgtgtggagtttgggggccaggccgggctagcggcagctgggctgagaggccgctgccagtgtcatggccacgctgcccgctgtgccgcccgtgcccggcccccccgctgcactgccgccacataccactggcccggggtgcgagagcttgccgccgtcccatcgagactggccctggcggctgcacgccccggaccccaaccttgcctaccctgctcctgcaaccagcacgcccgacgctgccggttcaactctgagctgttcagactgtcgggcggccggagtgggggtgtttgtgagcggtgccgccaccacacagctgggcggcactgccactactgccaacctgggttctggagggaccctagccagcctatcttcagccgcagggcctgcagagcctgccagtgccaccctattggggcaacaggaggaacctgcaaccagaccagtgggcagtgcacctgcaagttaggggtcacaggcctgacctgcaaccgctgtggccctggctaccagcagagccgctcccccaggatgccctgccagcgaattccagaggcaacaaccacccttgccactactcctggtgcttatagctctgaccctcagtgtcaaaactactgcaatatgtcggacaccagggtacacatgagccttcggaggtactgccagcaggaccatgttctccgcgcgcaggtgctagcgtccgaggcggcgggcccggcatggcagcggctggccgtgcgcgtgctggccgtttacaagcagcgggcgcagcccgtgcgacgcggcgaccaggacgcctgggtgccccgcgccgacctgacctgcggctgcctgcgcctgcagccaggcaccgactacctgctgctgggcagcgccgtgggcgaccccgaccccacgcgcctcatcctcgaccgccacggcctcgcgctgccatggaggccgcgctgggcccggcccctgaagcggctgcagcaggaggagcgcgccggaggctgccgcggcgtgcgggcacccacacccagtcccaggccggagcactagacgtgagatggggctgcctcgagcaccaacaaagtaatttgggagcgactaggagctgagccttctacctcgacggtgcactgcagagagccaatcagacgtcgcagagccccgacgacactatgcttgcgcccacgccgagcaggcgtgcggaacttttagcaaaaggcggcaagcgggacttctggtcccaacatttcctcctttggcctgtggcttattccccgccagtgatctgtttcccccaataaagtctcaaatctttggga

SEQ ID NO: 357611 - DNA, 2410 bp, Homo sapiens
gtcccatacagggggagctcaggcagggtcagcggagggacctgcgcctgaatcccgaagttccactctgactcacacagcctgggcccccagctctgacatgccccctctgatggggggcgtctcagccccattccatcctcctgcagctgatgcacctcccagctttcggagtgactcccttctttcaaatccgatgtccctgtcctgctcctgccaaatctggccccctccaacgtggtacctaagggtccagagtcgagggtcgcctttgctgtgccctcgcaccccctgggggcgggcctggggcagtgggtcccaagcctgtcaggattgggcccacgctacaccacgataaacgctggggccaggccactgcggacccatgctacgatccacagggccgcccccaattctgcctcccgccagtgacacagctggctgccgtggcggcctcctgccctcaggcctgtgccctgtccccaggaaaccaccttggcgccagggaaacctgcaatggcagcctgactttggccctgggtggccccttcctcctgacatctgtcagcttgcgcttctgtaccccaggacccccagccctcatcctgtctgctgcctgggcctcagggggtccctggaggctgctgtggcacaggcccgcctggcctggggccttagggggccctgaaagggtgaccttccactccacaccaggtcctaaggccactgtggcggccagccacctccgtgtggagtttgggggccaggccgggctagcggcagctgggctgagaggccgctgccagtgtcatggccacgctgcccgctgtgccgcccgtgcccggcccccccgctgcactgccgccacataccactggcccggggtgcgagagcttgccgccgtcccatcgagactggccctggcggctgcacgccccggaccccaaccttgcctaccctgctcctgcaaccagcacgcccgacgctgccggttcaactctgagctgttcagactgtcgggcggccggagtgggggtgtttgtgagcggtgccgccaccacacagctgggcggcactgccactactgccaacctgggttctggagggaccctagccagcctatcttcagccgcagggcctgcagagcctgccagtgccaccctattggggcaacaggaggaacctgcaaccagaccagtgggcagtgcacctgcaagttaggggtcacaggcctgacctgcaaccgctgtggccctggctaccagcagagccgctcccccaggatgccctgccagcgaattccagaggcaacaaccacccttgccactactcctggtgcttatagctctgaccctcagtgtcaaaactactgcaatatgtcggacaccagggtacacatgagccttcggaggtactgccagcaggaccatggtgagtgctggggagacagacagctgaaggctacacagctggttctgatgactgcttctaagccaccccctttctggccttccactttctcatcttaaatgggaaggagtgttggattccaaaccccttcctgatctagaaattgatggggcagaagacaaatggggaggggagtggggagggggcattcactaccttcctgtgtctcctctttccccatgttcttcggcttacagagtttcatcatctccttcagcctgacatctctgagggatggaagagataggggaactggttgagtggaatgaactcttgccctgtcctccctatctcagagaccctttctgcttcccttcatggtcccagatatttgagccttagccccacttcccataaagacttgtcccacggttccctaatccccagtccacacctgctccatgaccttggggtctatgacctcaggctattcagctctcttaagacactcaggagttcggcccagccaacaaatctagaccaacgccagctatttctctcaatgtataggaccgcagacttctccctcaggaacctcatctggtcactagtgttctaggccttcacaggtggaaagattttccccaccttccacagggatctcctgccccgcagacccagctggctagtcagagtcccacccagcctctcagaaagtgcatttttctggccgggcgcggtggctcatgctaataatcccagcactttgtgggggccgaggtgggcggatcacttgaggtcaggagttcgagaccagcctggccaacatggtgaaactccatctctactaaaaatacaaaaattagccaggcgtggtggcaggatcctgtaaacccagctgaggcacaagaatcacttcaacctgggaggcagaggctgcagtgagttgagatcacaccactgcactccagactgggcaatagagtaagattccgtctca

SEQ ID NO: 357612 - DNA, 2039 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaacc

SEQ ID NO: 357613 - DNA, 767 bp, Homo sapiens
  misc_feature (37)..(38): n is a, c, g, or t
cgggtgatatcgttccaaggatcccgtcgtcagcatnnacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccaggctgacaggggctgggaacactctggaaacctcacttggcatctagggaagagagcattctttgtctctctattgcaacctctggccttttcagaagcagcactggcagagtaaaacatgtctagcctctaattaaagaaaaattgtgtcactgtgtgacaaattagtctgtcaaatatactctgcccctaccatccgcctacctttttcttccctttttttttttcagatagtgaagatctttcataagtttttgtgtgttttacttttttgtttgttttatttcacagtatgatgtagatttcttgatgctaattcagtcttccatggcttgtgttattcctttttaatagtcacttgaaactatggaggaatcagcctctcatttgggtatgctgatggtgaagtcataacctcctttccctattaatactttttgtttctccttataagaatggagacctcagtcgagaccagcctgggcaacatagcaaggccctgtctctacaaaaaaaaaaaaaaaaaacct

SEQ ID NO: 357614 - DNA, 1232 bp, Homo sapiens
  misc_feature (1056)..(1056): n is a, c, g, or t
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccaggctgacaggggctgggaacactctggaaacctcacttggcatctagggaagagagcattctttgtctctctattgcaacctctggccttttcagaagcagcactggcagagtaaaacatgtctagcctctaattaaagaaaaattgtgtcactgtgtgacaaattagtctgtcaaatatactctgcccctaccatccgcctacctttttcttcccttttttatncagaagggaagacctcagaagaagggtgtaactcgggagcgaattcccgaagaattcactcctggaggcacacggctcaggtgtgttccttcaggcttgaatgagacccccaggagttaggaacaccacatcactacgatggcctaaggacagacggccaggctgcaacaaaggcc

SEQ ID NO: 357615 - DNA, 1129 bp, Homo sapiens
cataatttagccatgatagtatctaagctcactttcagaattattgcatacatgccttagggaagaacctatccactaatgcttttaataacttacatagattgtgttgcggcaagtcaagttttaatatagaggaaagggtttatcttatcatagtaaaatagtagtgatgtgttcataatttactatttgcatggtatattatcaaggctgtaaaagcttgaatttgccttttccacatcttcatttcaaattaatttttgtgaggacccagagaagtgggtagaaccaaatgcccatgtggttttgttatggttatttagatcatttcagggtggggagtattttcagcaccataatatttctgtaccagggagattatagtattctaatttttttagggaaaaattgcttagctctagggatttctaaactttgaacaataaaagttaattttagaaatactttcagggtcatcattaagctttagcgtggctttgttactgccctgttaagtagttttgttggttagtatggacagtacagcaaacccattatgattcctttacagtgagaaaaatatgaaatagtccagaaagaataagatattaagtaacctttgcctgaaggttctgtgaactccttaagcgtttgaatatatacttctccccaccccgaataagcgtattcttctgggaaaaggcaatgaaaaaagaaatgaactttcttctcagaccttgaaaagtttttagtgcatagtataatttttttcatatgatagactgagctttatgcacacaggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaacc

SEQ ID NO: 357616 - DNA, 1130 bp, Homo sapiens
cataatttagccatgatagtatctaagctcactttcagaattattgcatacatgccttagggaagaacctatccactaatgcttttaataacttacatagattgtgttgcggcaagtcaagttttaatatagaggaaagggtttatcttatcatagtaaaatagtagtgatgtgttcataatttactatttgcatggtatattatcaaggctgtaaaagcttgaatttgccttttccacatcttcatttcaaattaatttttgtgaggacccagagaagtgggtagaaccaaatgcccatgtggttttgttatggttatttagatcatttcagggtggggagtattttcagcaccataatatttctgtaccagggagattatagtattctaatttttttagggaaaaattgcttagctctagggatttctaaactttgaacaataaaagttaattttagaaatactttcagggtcatcattaagctttagcgtggctttgttactgccctgttaagtagttttgttggttagtatggacagtacagcaaacccattatgattcctttacagtgagaaaaatatgaaatagtccagaaagaataagatattaagtaacctttgcctgaaggttctgtgaactccttaagcgtttgaatatatacttctccccaccccgaataagcgtattcttctgggaaaaggcaatgaaaaaagaaatgaactttcttctcagaccttgaaaagtttttagtgcatagtataatttttttcatatgatagactgagctttatgcacacaggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacatagccccgccctgctcccatcccctactcccactgctcagcgcgggccattgcaagggtgccacacaatgtcttgtccaccctgggacacttctgagtatgaagcgggatgctattaaaaactacatggggaaacaggtgc

SEQ ID NO: 357617 - DNA, 751 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtgggtaagtgatggagaacaattatacgtgggcacttgccggaccattacaacgttcttggtttctgtggcgaaggtagcataacttaaaataggctgcgtacgctgcttggcgcgaccgctggaacctcattcctttaaagcgctgcggtccgccagacttggtaaatcagagcgctgctttcgctgaaaaggaaatgtccttgttaaagagagtgctcacggtcccatcttctcacagagtttcctctcggacgagaagggactaattgttgggttcctgaccggccgttaaacactgcgcgtgcgca

SEQ ID NO: 357618 - DNA, 821 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgaggtcagtttaaatagcagttggtgtgtcttcttggtgtttcctatttatttgttaactcttaattaaagttgtaagcgaagttacttttcaagggctctgataacctatttagccttaaaggagtctaaaggcgtacttgggaaactggacaggacaaaaaggggaggaagaaggaaacactgaacagaggttagaaaaaaatatatttaacttggaactgatacccaaaccagttgttggcctcatttgtgctatgtagtgcctattttgccatattctaataatgtcattgtaatt

SEQ ID NO: 357619 - DNA, 4851 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357620 - DNA, 3550 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaac

SEQ ID NO: 357621 - DNA, 5190 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacagaaaaaatctgttggctatgatatgcacatttttgggcaagttatgaactagagcccaaagtagtatttgacagttttatttactctgccgtaatttgcaagcttatcagttaagtctgtagtttttttaaaagccgtcatgatatttgtgattattagtacataaaccagtgttataatttgatatttgggtttttcagactttgagtggcagatttagagaattctttatgttcttgacatgtgatatagtatttatttaccttgagtggtaaggttttataaggtagggtttccatgatttaggatgtgaatgcgaaaacttacacattagttaatta

SEQ ID NO: 357622 - DNA, 4797 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtagaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357623 - DNA, 4619 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357624 - DNA, 3318 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaac

SEQ ID NO: 357625 - DNA, 4231 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaacaaaaaaaaaaaaaaaaaaaacaaaaaaaacaaaaaaaaaacaaaaaaaacaaaaacaaaaaaaaaaaaaaaacacaaaggggcgcgggccgcccagcaaacagcacacccacacaggcgagcacacaacacaatacacgcagacacaacacaagaatcatagtgacgaagagaggcggaccaaaaaaggatcgacaagtaatcaaaaaaacagagaggagcacaggagagcgaataataaaaacacgagagaacagaaaaagagaaaaaaaagaagacacatgtggtcgaccaacccctcgacgacgaaagacaacgaagatattaatactctgcaggctgggggggcaacactaaccaatataaggtagcgaccccaaagtatttccttctagcgaccaagagacgaaagctaatagaaaaccaccaacttaatgtgcgactgagaataataatcatcaaacacagctcgtccacagcaacgccggcacccacaataccctatagagactaggcatagaacaacagaaaggcagatgagtagtaagatagtctcgcgactgtatccagtttaagaaatagatatagcgtatatgtggagcatccaagtagagaccgaatatatcaaggaataaaaacgtaaggaacaaaaaatgataaatgataaaaatgacaacagggc

SEQ ID NO: 357626 - DNA, 4525 bp, Homo sapiens
taggagaagatgtacgaggccgtcccccgtttttaatttcagtacatcgtgactgcgcttaagttcgtaattacatggtccctcggcttacaatttaccaaaggtgtcccgaactaatggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357627 - DNA, 6130 bp, Homo sapiens
tcacgccactgcactccagcctgggtgacagaatgagtccctcatttaaaacaaacaaacaaaaaaaacgagaattcagattacttttaaaaacataaatattctagtctttgatactgtgaggtggttcatttctagctttcttgaaagtgaaatttccccacatttgaaaatgttttagttcctaagtttaagttcttaaatgactcccgcgggcatccctaccccttagttttactctactttgtgaccctgggcaagtgatttacctctgtgtgcctcgattttccctcccgaaattggcaaaaataatacctaatttctccctacctcacagggatgttgtgaggataaatgtgttcgtgtaagaaagaaattatataaaacctcaaggtattatttttgtggtgttgttactaaacaaatataaaaattcaacaaaaatagtgctttggattttgttacatttgttaaaaataactttgggcatttggttaggatatgaattagagtggagttagctcattttgaattatatatgacagtttagttcattgcttatttttaagataaacaaaaggaatttgaccaagaagtcataagttgttttttaaatctgtatgtttactgaaaaatctttcttgagatcttaaaattctgtgttgattttgttataaccgcctgttgaatgtttttatgcctaaatcttaaatagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcaggtgaaagatattttgttgctttaatattgtagatgtgcacgtaatccattctttggaagtgtctcatcaagaatacctaagatacgtgtttcacttttcagacttgtataaataagcacattctgtctcagttatcaatttttgagtattaaaataattagaatttgttttctgatttttttatttcattaggaaaatggtataaaagatcattacggaaaacttttgaaaaaattaaaaatgtataagtgcaatagctatatgatgttttattttctaatttatatttcaaaatggtatatttaaatgttaaagactagagaatgcacagtaattgaatatagctcatggttaagacatgaataaaaaatatagatcattttcctaagtgtaattccttgtgctatgtagaattatgactgtttttctagtgtcattttttttccattctgacatgacatgttaatggaattgtatataatttcctctgtagcatccaattcattcctagggacatagaactctgtggggaatagtgttgtatgttgggctttatttacttcattccctctgccagggtctacccttaaattatagtgctaggtgtcattttgaaataactgattgcaattattaacttataaactgctatcataatttaaaattttgaaagaattatttcatgaattctagggtagatttgataatggacatctagtattcaccttgagatggtaatcctctcattaataaatattcagatacttgtatacttggtatacagatacaacagtttttatgttgtttgaagaaatataatggcagggagcatctgcttaccctacttttgcatggtagatcccatgtaaacaagacaaagagctgtattggcagctggcctagaaaagcctctgaaaatagcaaaattgcagaaaatatttaatgattcattaacttctatctttgcttataaatgaatatatctgcaagattatagaaacagcttaagttgtttagttcactttttgttcactgtaagtaggatgttgaaattgacaaaaatgtctagttaaagagaaattagtatctatttgatgtcttagtgttggtaggattagcttgtaaatggattcagaatgaaaaatttcatatacttcttgaaagtagcttatcagctggcttttagaagcctctttgcatttacatagccggaaaatcttaagacaagtaagcctaggttcttgggaccatagaagtatcggtggatattagagccatggaattcttggatgtgctgcacacatggatttctactgtcccagttcataacacacgtgtgtcccagagagtatattgtattaatttgaagaaaaaataaactgcaatactctttcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357628 - DNA, 5030 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagcatacaggaaaggatcaatctagaaggattcatttagtaaacatttattaaatgcctgctatgaactaagccttgggatacaaaaataaagaagaaaccatgccctggttatgtgagtcactggttcttgaacagggttgtgtatcagtgttggaataaagtacaaagatattagacttatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357629 - DNA, 2983 bp, Homo sapiens
  misc_feature (1969)..(1969): n is a, c, g, or t
  misc_feature (1993)..(1993): n is a, c, g, or t
  misc_feature (1997)..(1997): n is a, c, g, or t
  misc_feature (2005)..(2005): n is a, c, g, or t
  misc_feature (2007)..(2007): n is a, c, g, or t
  misc_feature (2011)..(2011): n is a, c, g, or t
  misc_feature (2013)..(2013): n is a, c, g, or t
  misc_feature (2017)..(2017): n is a, c, g, or t
  misc_feature (2024)..(2024): n is a, c, g, or t
  misc_feature (2026)..(2027): n is a, c, g, or t
  misc_feature (2031)..(2031): n is a, c, g, or t
  misc_feature (2035)..(2035): n is a, c, g, or t
  misc_feature (2041)..(2041): n is a, c, g, or t
  misc_feature (2047)..(2047): n is a, c, g, or t
  misc_feature (2051)..(2051): n is a, c, g, or t
  misc_feature (2057)..(2057): n is a, c, g, or t
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggagggagagacagagagagacagacagacaggcagagaaagagagtaagacagaagataggcanagagagagagagagagagagaganaganagagagananagananaganagagagngnnaganaganagaganagaganaganagaganagagagagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaac

SEQ ID NO: 357630 - DNA, 4671 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357631 - DNA, 3965 bp, Homo sapiens
gcatgcctctgtgaatgagtgcttggggtgtgtgtgttgagtgtgtggccttgtgtgtgcatatcagacggagtggctgacattgctgcagcatctgccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357632 - DNA, 3941 bp, Homo sapiens
cataatttagccatgatagtatctaagctcactttcagaattattgcatacatgccttagggaagaacctatccactaatgcttttaataacttacatagattgtgttgcggcaagtcaagttttaatatagaggaaagggtttatcttatcatagtaaaatagtagtgatgtgttcataatttactatttgcatggtatattatcaaggctgtaaaagcttgaatttgccttttccacatcttcatttcaaattaatttttgtgaggacccagagaagtgggtagaaccaaatgcccatgtggttttgttatggttatttagatcatttcagggtggggagtattttcagcaccataatatttctgtaccagggagattatagtattctaatttttttagggaaaaattgcttagctctagggatttctaaactttgaacaataaaagttaattttagaaatactttcagggtcatcattaagctttagcgtggctttgttactgccctgttaagtagttttgttggttagtatggacagtacagcaaacccattatgattcctttacagtgagaaaaatatgaaatagtccagaaagaataagatattaagtaacctttgcctgaaggttctgtgaactccttaagcgtttgaatatatacttctccccaccccgaataagcgtattcttctgggaaaaggcaatgaaaaaagaaatgaactttcttctcagaccttgaaaagtttttagtgcatagtataatttttttcatatgatagactgagctttatgcacacaggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357633 - DNA, 3344 bp, Homo sapiens
aattcgcggccgcgtcgacagaagacgacagaagggaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357634 - DNA, 1402 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggaggtcctggaggtcctggttgccaataaggaggatgaaatccaccttgcggtggaccaaaagcagccccatgctgaaagagtattgcagttta

SEQ ID NO: 357635 - DNA, 1593 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccaggtttgttgtttatgttttcacaattttaagacttttaaaaaacagaatgaagattattattaaattttttaatttgcttagttgtatgacttctggaaattaatgcttcttaaagaataggcagttttcaatttgatttgactttgacattttgtggttaaaattattctgtactcattctgctagctttgtggcactcagtttgattcttttcttggttcttcattcctaggctgacaggggctgggaacactctggaaacctcacttggcatctagggaagagagcattctttgtctctctattgcaacctctggccttttcagaagcagcactggcagagtaaaacatgtctagcctctaattaaagaaaaattgtgtcactgtgtgacaaattagtctgtcaaatatactctgcccctaccatccgcctacctttttcttccctttttttttttcagatagtgaagatctttcataagtttttgtgtgttttacttttttgtttgttttatttcacagtatgatgtagatttcttgatgctaattcagtcttccatggcttgtgttattcctttttaatagtcacttgaaactatggaggaatcagcctctcatttgggtatgctgatggtgaagtcataacctcctttccctattaatactttttgtttctccttataagaatggagacctcagtcgagaccagcctgggcaacatagcaaggccctgtctctacaaaaaaaaaaaaaaaaaacct

SEQ ID NO: 357636 - DNA, 1361 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccaggctgacaggggctgggaacactctggaaacctcacttggcatctagggaagagagcattctttgtctctctattgcaacctctggccttttcagaagcagcactggcagagtaaaacatgtctagcctctaattaaagaaaaattgtgtcactgtgtgacaaattagtctgtcaaatatactctgcccctaccatccgcctacctttttcttccctttttttttttcagatagtgaagatctttcataagtttttgtgtgttttacttttttgtttgttttatttcacagtatgatgtagatttcttgatgctaattcagtcttccatggcttgtgttattcctttttaatagtcacttgaaactatggaggaatcagcctctcatttgggtatgctgatggtgaagtcataacctcctttccctattaatactttttgtttctccttataagaatggagacctcagtcgagaccagcctgggcaacatagcaaggccctgtctctacaaaaaaaaaaaaaaaaaacct

SEQ ID NO: 357637 - DNA, 1281 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccaggctgacaggggctgggaacactctggaaacctcacttggcatctagggaagagagcattctttgtctctctattgcaacctctggccttttcagaagcagcactggcagagtaaaacatgtctagcctctaattaaagaaaaattgtgtcactgtgtgacaaattagtctgtcaaatatactctgcccctaccatccgcctacctttttcttccctttttttttttcagatagtgaagatctttcataagtttttgtgtgttttacttttttgtttgttttatttcacagtatgatgtagatttcttgatgctaattcagtcttccatggcttgtgttattcctttttaatagtcacttgaaactatggaggaatcagcctctcatttgggtatgctgatggtgaagtcataacctcctttccctattaatactttttgtttctccttataagaatggagacctcagtcgagaccagcctgggcaacatagcaaggccctgtctctacaaaaaaaaaaaaaaaaaacct

SEQ ID NO: 357638 - DNA, 485 bp, Homo sapiens
  misc_feature (469)..(469): n is a, c, g, or t
taggagaagatgtacgaggccgtcccccgtttttaatttcagtacatcgtgactgcgcttaagttcgtaattacatggtccctcggcttacaatttaccaaaggtgtcccgaactaatggcatacataatcttgctgctatgcttcgaagctgtagtctgaatcaacctaagttttaaacagaaggtgaacctctgagaaaatccagttcttagaggaaaagataaaagctaacagtaagatgtcagctgtggatttatcatatatggccattattatgttgaggtactttccttctgcacctaatttattgagagtttttatcacgaagggatgttgaatattatcaaatgattttcctgtcctttaaactcttgaaataatggttagaaatgtcatcctttttttttttttgttctagagacagagcgagacctccccccaaaaaaaaataattaaaggaaggaagnaaagttacccttaccc

SEQ ID NO: 357639 - DNA, 5571 bp, Homo sapiens
  misc_feature (2159)..(2159): n is a, c, g, or t
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaaggtatattttggtgtttctggttttgcttttcctggggtattttggttctgatgactattttggcctttttttgttgtccttgttggatttctaccagatatttgaatattctcttgcatgttttaactcttaaagattagattcgtagacaccatattaaagctatacaaatatttttgttttatctgacctacatgagtacaaattagcaatcatgctgttttcctctaaaatgtattgtggaaaattccaggtgttcagtttatttcacctgattttttttaatagataacatggcattgttgtgtgacttctgatacagtttattttgactaatgaattttgaattatctacctacaatttttagtttaccacttatctcttacagaagcaagtgatttcctacccctagatttttagtaacaccttaaaaatgtattgaaaacaaaaattaagttacatgtcataatctcagaagtagacatacagatatacctgtcnacattttttctcattataaaccaatttcagctcacatcagagttataatttcaaagccagacatgatactggtttaaaatgaatgttatgtttttaatgtttcttctctccccaaaaagcagcaatagtagtagatttaacaataccatagactcatgactatgaaatcgtggctatttgtgttaacatgttgttcctgttgttgatgtgatacaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357640 - DNA, 4797 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaaggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357641 - DNA, 4797 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaatcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357642 - DNA, 3496 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaatcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaac

SEQ ID NO: 357643 - DNA, 3077 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaaaattttaattttttccccacccccaaagggggggagtgttttttttttgggggggc

SEQ ID NO: 357644 - DNA, 6247 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcaggtgaaagatattttgttgctttaatattgtagatgtgcacgtaatccattctttggaagtgtctcatcaagaatacctaagatacgtgtttcacttttcagacttgtataaataagcacattctgtctcagttatcaatttttgagtattaaaataattagaatttgttttctgatttttttatttcattaggaaaatggtataaaagatcattacggaaaacttttgaaaaaattaaaaatgtataagtgcaatagctatatgatgttttattttctaatttatatttcaaaatggtatatttaaatgttaaagactagagaatgcacagtaattgaatatagctcatggttaagacatgaataaaaaatatagatcattttcctaagtgtaattccttgtgctatgtagaattatgactgtttttctagtgtcattttttttccattctgacatgacatgttaatggaattgtatataatttcctctgtagcatccaattcattcctagggacatagaactctgtggggaatagtgttgtatgttgggctttatttacttcattccctctgccagggtctacccttaaattatagtgctaggtgtcattttgaaataactgattgcaattattaacttataaactgctatcataatttaaaattttgaaagaattatttcatgaattctagggtagatttgataatggacatctagtattcaccttgagatggtaatcctctcattaataaatattcagatacttgtatacttggtatacagatacaacagtttttatgttgtttgaagaaatataatggcagggagcatctgcttaccctacttttgcatggtagatcccatgtaaacaagacaaagagctgtattggcagctggcctagaaaagcctctgaaaatagcaaaattgcagaaaatatttaatgattcattaacttctatctttgcttataaatgaatatatctgcaagattatagaaacagcttaagttgtttagttcactttttgttcactgtaagtaggatgttgaaattgacaaaaatgtctagttaaagagaaattagtatctatttgatgtcttagtgttggtaggattagcttgtaaatggattcagaatgaaaaatttcatatacttcttgaaagtagcttatcagctggcttttagaagcctctttgcatttacatagccggaaaatcttaagacaagtaagcctaggttcttgggaccatagaagtatcggtggatattagagccatggaattcttggatgtgctgcacacatggatttctactgtcccagttcataacacacgtgtgtcccagagagtatattgtattaatttgaagaaaaaataaactgcaatactctttcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357645 - DNA, 4771 bp, Homo sapiens
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357646 - DNA, 2929 bp, Homo sapiens
  misc_feature (1969)..(1969): n is a, c, g, or t
  misc_feature (1993)..(1993): n is a, c, g, or t
  misc_feature (1997)..(1997): n is a, c, g, or t
  misc_feature (2005)..(2005): n is a, c, g, or t
  misc_feature (2007)..(2007): n is a, c, g, or t
  misc_feature (2011)..(2011): n is a, c, g, or t
  misc_feature (2013)..(2013): n is a, c, g, or t
  misc_feature (2017)..(2017): n is a, c, g, or t
  misc_feature (2024)..(2024): n is a, c, g, or t
  misc_feature (2026)..(2027): n is a, c, g, or t
  misc_feature (2031)..(2031): n is a, c, g, or t
  misc_feature (2035)..(2035): n is a, c, g, or t
  misc_feature (2041)..(2041): n is a, c, g, or t
  misc_feature (2047)..(2047): n is a, c, g, or t
  misc_feature (2051)..(2051): n is a, c, g, or t
  misc_feature (2057)..(2057): n is a, c, g, or t
ggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggagggagagacagagagagacagacagacaggcagagaaagagagtaagacagaagataggcanagagagagagagagagagagaganaganagagagananagananaganagagagngnnaganaganagaganagaganaganagaganagagagagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaac

SEQ ID NO: 357647 - DNA, 4435 bp, Homo sapiens
gtatctctgatgtgttaggaattgacactttattttttatggtcataaagcttaaaattacaaaaatgatactggtctgaaattaaaaggtttaaataattttatttaaacctttacattaaattccagattttgtgatgaagtgaaaatttatgctagccatagcatgttggtattttcttcagtgtaggcatttcagtacattatacagatatatgagcccttctccttttaaatctaattgttcaatctctgtccactcttagttcatctgatgcactgctgtcagattaattttcctctggttatttcacttcccttaagtattttggcagaaaatttcaattttttaaataacattatagagccagcctatttcaagtgacaaatacatatttatgccactttatatctggaaagttctaaattgttcagtatttaatggacaggagcatttgttaataaatctttactttttacattttaggaagattctaactttactccttttttaacttactagcaaatcacttaattttttcgagtctcagtttcctcacctgtggaaaaaagtggagtaatagtagtgatctctgagggcttttgtaaggattaaattagatgatggtttaacatgctttcattgtgtcctggcagattgtaagcactagagcagtggtccctgctgttactaaaagtgatggcattgaagaaaggcatgatatttaatgggatattttttaaatttactcacaagtttgtagaaatattttacttaactgacttgcgtatatttttcccacgtgaaacagacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357648 - DNA, 3912 bp, Homo sapiens
tggggggggggtttggttatttttttaaacccacttgtagtttgggttcagcgtggaaagcaggacataccgaccgagggagggtggtcgcactagcggggttccccggactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357649 - DNA, 3301 bp, Homo sapiens
caagctatagagaacttgaaatgtggctaggcatgtgctgtgggtataaattacatgctagatttcaaaaactttacttgaaaaagagaacagaatttttttaaatttattatgtgttgaaatgataatatttttggtatattgggttattttacctgtttctttttacttttttaatgtggttactaaaaaattttgaattacttacatggcttgcatcgtaattctattgaaaatggtgttctattgttacagtctggtagcttgacatttggtagtatgagaattttacatgaacattttcttagtgtttttgtctttttctgtttcagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcatgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacaga

SEQ ID NO: 357650 - DNA, 768 bp, Homo sapiens
cccatggccctagttttaaacatacatccaatctcaaatgatctcatctatgcatttgctcacttataatctttttctccttattagaatttaagccacttgagggcaagaagccagtggatctcatccaccgacgtatccctcgcaccattgaccgaaacacaggagcgctatcgacatgtgccgaatgaatgaatgaatgaatgaatgagccccaggtgtttaggagaccctaacagaggtgcccccgttgtagggacgactctcacctgcagatggcctcctcaggcccttcgggtggcactggggagcccagggcctcccagcgaagtggccagattcaggaacccttcgcacagcgggcactaggaccctgcgcggcgccgcgtctcgcggggggcgggcgggcggagggggttgggggatccgctctttctccctcctagagcctggttgcagccacttgtgcgatcccggaccttgccgcggcgcctggctcctttccgcgccatgagccgcaggttcacggtcacctcgctgccccccgcagggcccgccagaagccctgacccagagtcccgccggcattcggtcgcagacccccgccacctcccgggggaagacgtcaaaggagctaataatcagaggctgctgaggggcatggatatgactgcatccttgtctcttctatggaggcaagacgacttttataagttctatcaatgaagagagtcctaaactggagtaaagcaaactggatgctagacc

SEQ ID NO: 357651 - DNA, 1082 bp, Homo sapiens
cccatggccctagttttaaacatacatccaatctcaaatgatctcatctatgcatttgctcacttataatctttttctccttattagaatttaagccacttgagggcaagaagccagtggatctcatccaccgacgtatccctcgcaccattgaccgaaacacaggagcgctatcgacatgtgccgaatgaatgaatgaatgaatgaatgagccccaggtgtttaggagaccctaacagaggtgcccccgttgtagggacgactctcacctgcagatggcctcctcaggcccttcgggtggcactggggagcccagggcctcccagcgaagtggccagattcaggaacccttcgcacagcgggcactaggaccctgcgcggcgccgcgtctcgcggggggcgggcgggcggagggggttgggggatccgctctttctccctcctagagcctggttgcagccacttgtgcgatcccggaccttgccgcggcgcctggctcctttccgcgccatgagccgcaggttcacggtcacctcgctgccccccgcagggcccgccagaagccctgacccagagtcccgccggcattcggtcgcagacccccgccacctcccgggggaagacgtcaaagtctcccctcagggggcactcatcaggggtcctctccctggctctgaggccctcgggtctggaaggaacaaggcgaatcggcttgtagtggccccagcgaggggaggaggaggaggaggaggaggaggaggaggaagaggaggaggaggaagaggaggaggaagaggaggaggaggagaaggaggaggagaagcctccccagaccgccaggggtcgctgccgagccgcagcaaatccaactgatccccacgtcttggccattcacctctgaaacttatcctgaatctggcagcatcggtcccccctctgtcatcatcgccctgctccaagcctcacatggccacgaccacatcctctccactggcctccctgcctccagtccttccctagccctcctccacagaagccccccatcacttgcaaaataaaggccaaagccttaagtctgtcat

SEQ ID NO: 357652 - DNA, 585 bp, Homo sapiens
ggttgggggcgtcttcctcgcgggccctgtgcagggtcttgtaatggaagttacacgcagggcacagagtataggggaggggaaagatccttctggccttcggtggagaagtagcatcctgggcgcgtgcacagtctcccctcagggggcactcatcaggggtcctctccctggctctgaggccctcgggtctggaaggaacaaggcgaatcggcttgtagtggccccagcgaggggaggaggaggaggaggaggaggaggaggaggaagaggaggaggaggaagaggaggaggaagaggaggaggaggagaaggaggaggagaagcctccccagaccgccaggggtcgctgccgagccgcagcaaatccaactgatccccacgtcttggccattcacctctgaaacttatcctgaatctggcagcatcggtcccccctctgtcatcatcgccctgctccaagcctcacatggccacgaccacatcctctccactggcctccctgcctccagtccttccctagccctcctccacagaagccccccatcacttgcaaaataaaggccaaagccttaagtctgtcat

SEQ ID NO: 357653 - DNA, 958 bp, Homo sapiens
atattatggtagataactggatagtacttttttactttctgagtctgtacagtctaatcttcctgaatgtttgggctgtttaatttctttaaagatgataaatattacccggtcatccatcatgctctatctataggctataccattcatatgttgggcaatgctgtattataaaacacatgtaaacatgtatgtaacccatgtttaacccagcgtagttgtagcatgtggttgtattaatgaacgttacaggagagctttataatcatttataaatctgtaacattcaataaagaaacacatgttgcaatgattaattatgttcccaattccatgttatttagcatctttgtgaaccgggcatttttgttcctgatctgcttgatgcttttcatgttcctttggaccactgtaaaatatgtgtgtaagctgatgtatatcctctaatgagtcctgcgagctgtggtaggcaagttgtgattttgtgaaagatgaactggcatgttatgcaaaagactatatgacaaatgaacttaaaatgatattttaaactccagttgaattagctgtttacatctgccaaccccatgcagaagcagtgtacagtattttataaatatgttcatttagtaacactatgttgtttctagataaagtgatactagtgtgtaggtggttatatatttggcctagatattgcattataactcactatcctttaacaataacaatgtgactgaaatgaagtaatctctctccaaacctggtcttaattttgtgtcaacaaaatgcatgcactgctttatgcatttcttttgacttttctaaggcacttaacattttactattgcctgctgtgacgcttaagccagttaagaattcactcaaacagttgggcttcttactatggggattatgttcagttttgaaaaattaaaaacaaaaaaaaagtaaccaa

SEQ ID NO: 357654 - DNA, 212 bp, Homo sapiens
cctgtcacctaggtagtgagcatagtaccccataggtagtttttcaccccacttccccccaccatactcccccttcactgacaactacttttataactgccctttttcaaaaacttttgctgccttctctgagaccctgcctgatatggcaccatcagggtccctcgtccctggtccctggtccctgtcctttttttttttttttttttttt

SEQ ID NO: 357655 - DNA, 318 bp, Homo sapiens
cataaggccagccagttctagctctctattacctgtccccactcaactgactcatacctgtttccggctgcatcactgtgtgccccacagagaacgatgatcgtcacctctgtgcctgagttctccctgttgtctcaaagcggtacccatcctcccccagaagctgtccccagcgagcctcccttctttgtttgaattctctaataagagcaacagcagctcccatttctagaacacatttacagtattactattttctaggatataaagtgccatatatatttttaattccaatattaataaatgtatgccaaacaa

SEQ ID NO: 357656 - DNA, 1967 bp, Homo sapiens
cgggatcaatttgatttgacagtcggtataactgatcctgagcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccacccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttcatggcaccatcaggagtaacagaaaacc

SEQ ID NO: 357657 - DNA, 152 bp, Homo sapiens
ggatttgctggtgcagtacaactaggcttgatccatgaagaacaagaccaagagccacaggatctctttgcaggcaagtttggactcaaaagttactctaggaacctcctaaatggctttgttaagttgctgagttaaagtcaaaaccaaaa

SEQ ID NO: 357658 - DNA, 1884 bp, Homo sapiens
  misc_feature (1884)..(1884): n is a, c, g, or t
ctcgataaagtgttgttgcggcttccgccgcgggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccacccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtcttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggtaaaaaaaaaaan

SEQ ID NO: 357659 - DNA, 2056 bp, Homo sapiens
  misc_feature (2056)..(2056): n is a, c, g, or t
ctcgataaagtgttgttgcggcttccgccgcgggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccacccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagaggggcagcagataacttgccatccctgccttcttggtcttgtagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggtaaaaaaaaaaan

SEQ ID NO: 357660 - DNA, 2271 bp, Homo sapiens
  misc_feature (2271)..(2271): n is a, c, g, or t
aggttcaggagagcagagaaaaggcggggccagacggagtagctcgaaggacctagggaaggggcctcaaggactacaagttccagcgtgctttgctcgatttcggcgggacaaaaacaatcttcgcggctcgtcagcacattgcatgctgggatgcgtgagctattttcttcggaaggcagcgaattgtattctgggacttgtagtgtccgcctggtagaagtggatgtaacggtctgttaaccgcgactgactcactcagtatccgtgataagttaaagatgaatcctgaaggggtaggggaaaggagatcttgagttctccagcacggagactctttacaattatttctccgcgggatccgctgacagccaacgtctttcttacttcctgatcggacaggaagtaggtttcagttgctgtgaaaagggatgtcatgggaagccagtgaggtagtcagagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccacccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggtaaaaaaaaaaan

SEQ ID NO: 357661 - DNA, 1851 bp, Homo sapiens
  misc_feature (1851)..(1851): n is a, c, g, or t
gtccctgtttgcagatgacatgattgtatatttagaagctagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccacccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggtaaaaaaaaaaan

SEQ ID NO: 357662 - DNA, 2131 bp, Homo sapiens
  misc_feature (2131)..(2131): n is a, c, g, or t
ctcgataaagtgttgttgcggcttccgccgcgggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagggtctcactctgttgcccaggctggagtgcagtggtgtggtcatggctcactgcagccccgacctcccaggctcaagtgatcttcccacctcaaccttctgagtagctaggaccacagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccacccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggtaaaaaaaaaaan

SEQ ID NO: 357663 - DNA, 1945 bp, Homo sapiens
  misc_feature (1945)..(1945): n is a, c, g, or t
ctcgataaagtgttgttgcggcttccgccgcgggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccactagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccacccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggtaaaaaaaaaaan

SEQ ID NO: 357664 - DNA, 682 bp, Homo sapiens
agtgttataccttcctttgcgtgtcagatgggtcagtaatatccacacagctgggcttcagttaacagtttagctgaggctacagagtaagcatgggtcagagcttgagttctggactccagtgtagtatcctggtcactagaatgtgcacagtcagcatttgaaagaataaaggtcatcagctgagaaagagaaatacatttggacatgttcttttgaaaattatctgtgtgtacacatacccatgttggtatcatgtgctttggggtagggcatttgagcgaggttatgctgttagaaattaaccctaaaatgtatggacttatttttgctctgtcatgacttgggcagcacttattttactaataacgatttgctgcttattgaactggctgactggtggcaactgagggaggcattaaaagttgctttctaggcaagttgggtttgtttttcatggtaatgttttattcagagtatctctttgttttcagagtaaacatcagtctccaaagataactacatcccttcttcccatcaacaatggctccaaagaaaatgggatccatgaagaacaagaccaagagccacaggatctctttgcaggcaagtttggactcaaaagttactctaggaacctcctaaatggctttgttaagttgctgagttaaagtcaaaacca

SEQ ID NO: 357665 - DNA, 2013 bp, Homo sapiens
  misc_feature (2013)..(2013): n is a, c, g, or t
ctcgataaagtgttgttgcggcttccgccgcgggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccacccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggtaaaaaaaaaaan

SEQ ID NO: 357666 - DNA, 815 bp, Homo sapiens
ggctgtaccggcccggaaggtcttacgacgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccagggattacaggcgtgagccaccacacccggccctaagttgttttcttaaagacctgaaggcatccacacagtaagcctgttaaggacaagtcccatttggatacccacctgacctggtaagcattggagcttctctgacccctgcaagacattctttccccagatgggcaggggttgcccagtggcagtagtagcagaggctggaagcacagaagcatcttaggtgagtagctggggaccttaatggcagacatgacaaaactccacttgctgagaagccaccgacagcaccctggggacagctagcatatgaggcagggccactcccttccagacctcgaggctggagctcctgccatcctggcttctgcctgttgccccagttcttggtccctcagctctcttcacagtgaacccctgttacttgagggaccaagtgtgtctttgatgcttgaacccc

SEQ ID NO: 357667 - DNA, 1196 bp, Homo sapiens
ctcgataaagtgttgttgcggcttccgccgcgggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccacccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaaggtaacaagctctgaaatgcacttggagctaggggaaattgttgtctctagtgaactggagatgcgagggcatgctgttccaatcctctcagccatccaagttgaaattctcagcccacctggtccttgatgttctgat

SEQ ID NO: 357668 - DNA, 1818 bp, Homo sapiens
  misc_feature (1818)..(1818): n is a, c, g, or t
ctcgataaagtgttgttgcggcttccgccgcgggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcaggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccacccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggtaaaaaaaaaaan

SEQ ID NO: 357669 - DNA, 2230 bp, Homo sapiens
  misc_feature (2230)..(2230): n is a, c, g, or t
aggttcaggagagcagagaaaaggcggggccagacggagtagctcgaaggacctagggaaggggcctcaaggactacaagttccagcgtgctttgctcgatttcggcgggacaaaaacaatcttcgcggctcgtcagcacattgcatgctgggatgcgtgagctattttcttcggaaggcagcgaattgtattctgggacttgtagtgtccgcctggtagaagtggatgtaacggtctgttaaccgcgactgactcactcagtatccgtgataagttaaagatgaatcctgaaggggtaggggaaaggagatcttgagttctccagcacggagactctttacaattatttctccgcgggatccgctgacagccaacgtctttcttacttcctgatcggacaggaagtaggtttcagttgagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccacccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggtaaaaaaaaaaan

SEQ ID NO: 357670 - DNA, 1019 bp, Homo sapiens
  misc_feature (1019)..(1019): n is a, c, g, or t
cagctgatttgtcccttttccttgtgagatcagagaggcctctgctgtcttttcctccttccagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggtaaaaaaaaaaan

SEQ ID NO: 357671 - DNA, 1011 bp, Homo sapiens
aaagcatatatccatcccagtaattgtacacaaatgttcatagcactttattttctgtattagccccaaactggaaacaatccgcttatttatcagcagatgaatgtataaacacactattagaatatccaaacaatgtaaatattactaataaaaatgaacggactattgttacagcaatatggatggatctcaaaataattctactgaggacaagaagccagacaaaaaagaaagcacacaataattagaattacaaaagggcagaagtaaacttttgggagagatggatatgttcatgatttttattgtggctgctgttttacaagtatatacctatgttaatatgtatccaagtggatactaaatatgtgcagcttattgagtaattattgagcaattacgccttaatacatctgctaaaaaaaatctggcagacttttacccagaatatacaaagaactctcacacctcaataagaatcaacacaaaatttggcaaaatatttgaatagaaatttcaccaaagaagatattttgaatcatccataaccatactataatgattaaaattacaaaaactgatacaacttaaactctcatgcattgttggtggaaatggaaaatggtgcatctactctggaaaacagttttgaacttgcttataaagataaatccacacttaatcatacataaccatgcaacccagcaattccactcctaggtgtttccctaagagaaatgataacatatgtccacaaaaagccttgtccatgaatgtttatagtggcattgttcatggtcaccaaaaactcaaaacatctcaaatgttcattaacttgcaaatggataaacaaattgtgttctctatatacaatgaaatattatttagcaacaaaaaggaaggaactactgaaccacaacagaagttgtaggaactacagctcagatatgagtatcaaaaacatgctatggtaaagaagccaaaaatgaaaagactacataatatatt

SEQ ID NO: 357672 - DNA, 754 bp, Homo sapiens
gatcctaaatgtgtctctagcaaacctcaaagtacacaaaacaaaactgattgagctgaaaagagaaaagcacatttttaattgtatttggaaaattcatcacttcactgttagcaattggtagaattactagccatgattactagcagatacagaagaacaggacagcatcatcagccaacaggactgaagcaacattgtagaatagtgctcaacaaggccgggtgcggtggtccatgcctttaatcccagcactttgggaagcagaggcgggcagattgcttgaggtcaggaattcaagagtagcctggataacatggtgaaaccctgtctctactaaaaatacaaaaattagccaggcatggtggcgcatgcctgtattcccagctacttaagaagctgaggtaggagaatcgcttgaactgggaggcgaaggttgcagtaagccaagattgtgttacaaagcttgggttacagaataagactctgtctcaaaaaagaaaagaaaaaaaaagagtagtgcccaacaacagcaaaataaaatttttttctcaagtgtccatggaatattcagaaagatagaccatattctgggccataaataagccttggcagatttaaaagaattgaaatcattctgagtatgtatgttttctggccataatgaaaccaaactacaaatcagtaatagagtgacaataggaaaatatctaatcatttagaaattaaacatcagacttctaaataaagtctg

SEQ ID NO: 357673 - DNA, 489 bp, Homo sapiens
tgagcagcggaattcggaattctcagttcaccctcgagcgtcttaacgtgggcctggacgcctgtctgacgccctccagaggctggaagcagcaggaagagcccaggactgtggccttgagcagcccggagggcccaggaccaggctgcctcagcctctgaggtcccatcgtggcgggctgtggggcgttggtcggataggcagggcaggcacagaacagaccaggtgtccgcctctggccccgtggccttgctgagctctgtgtggagccaggcagcagaagaagcccctctgagtgaggggctgcggctcctccttgcggcagtgtggcctgctctttggttttccactggagttcacagctacctccttggctgaggtcaagggagccacgtgtgcagtgttctgtgtgaagtgtgccgtgtacagacccgttctcctctgtaacattcaggaaataaaactctttgctgtaaactgcctgcgttg

SEQ ID NO: 357674 - DNA, 323 bp, Homo sapiens
atgatgaaaccccgtctctactaaaaatactaaaagccgggcgtggtggcgcatacctgtaatcccagctacttgggaggctgaggcaggagaatcacttgaacccaggaggcagaggttgcagtgagccgagatcgcaccacagcactccagcctgggctatagagcaagactccttctcaaaaaaaaaaaaacaaaaaacagtatttcctgcttttgttatacatagcaacagccttgtctttatgtgtagggaaaagaaatgtttgatcctatattcaggctttattagtcaataataaagataaatatttgttgacaag

SEQ ID NO: 357675 - DNA, 1043 bp, Homo sapiens
ttagtgcttgagtaagggggacaggtctgcggcaatccctgtccactccggcaggaaggctgcctctggcttaaagattttgaggaaaggggagtcggggagggtgtaattggccaggtagatggtgtctccgcccgtgaggtatgcggcccagatcccgaacgtcccaatggtcatgatggtgtggttacactgtgtgagtagagcaaaatctttggcaggtgagccctcaatgccatcgccagcaaacaccacatcaccgtgggaggtgtcaatgttctcccgacaccaggccatgccattactggtgaccacgaagatgagggagctgtagcgagctcggaaccagtccagggcctgctgtaggtatcgccggtcggccaccacccccttccacacttttggcatgacatggacatagtcccctcggcgaacatggacccctacaaaggtgcccggccggctcccgttcacctgcaggccccgcaggaacttctgggcctcctcccgcacgtggtcgtgcagggtgaactcctggaggatctcctggcggaggtggtggtagaaggtccaggagcaggggtagccggtgaagcggacgtactcccccgggatgtggcggtattcctcctccatccagtcgttcaggtggtagttctgccaggggatcctgctggccgtggcgctgtgcagcaccggcagggtgattctgaagatgggggccagggtgctgtgcatctgggccgggatgaaggcgggccgcccgttcatcttggccagggcgtacagcgtggcgtactcgcccatctggttccccaggcggcccttggagttgatagtgaacaggtcctcccggggcaggtgtctgggggccaggaccacacgggctgagtatgcccagggcgcaggcaccagagccaggtgctggtggcagtgaaagatggtggacaccacaaaaatggcaaagacgaagtagaaggtggagaaggaagggcgggtggcccagaatcccttgacggggctgtggggaggagagaggacat

SEQ ID NO: 357676 - DNA, 368 bp, Homo sapiens
ccacacccccccccccccatgaagaccttcaagtagttcagcctactgctgaatctggacgtcccgattcccccctcctattggcttcttgtggttcagcccagtgcttctcgacctggtacattctggttccccgctcgcagacttccgacggtagggcccagcgcggcgcagcccacgccccctgcacaccccccgccccttccatcctatactgacgccccctgccgttgttctcttacatggatggtgtcccccatggtcgctgagactccccttcgaggattgcacccgcccgtcctaagcctccccacaaggcgaggggagttacccctaaaacaaagctattaaagggacagaatacttcc

SEQ ID NO: 357677 - DNA, 1911 bp, Homo sapiens
gcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttaggcctactatggggcagaagcaggaagcaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagctcacatcggaccagcacctgaccccgaggactggtggagctacaaggataatctccagggaaacttcgtgccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgtggatggtgtcccccatggtcgctgagactccccttcgaggattgcacccgcccgtcctaagcctccccacaaggcgaggggagttacccctaaaacaaagctattaaagggacagaatacttcctgttttctcagtggtctgattctaggcgcggtggggaaacatttgggtattaaagaacagacttcttccggaaacca

SEQ ID NO: 357678 - DNA, 1834 bp, Homo sapiens
gcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttaggcctactatggggcagaagcaggaagcaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagctcacatcggaccagcacctgaccccgaggactggtggagctacaaggataatctccagggaaacttcgtgccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgtggatggtgtcccccatggtcgctgagactccccttcgaggattgcacccgcccgtcctaagcctccccacaaggcgaggggagttacccctaaaacaaagctattaaagggacagaatacttcc

SEQ ID NO: 357679 - DNA, 1888 bp, Homo sapiens
gcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttaggcctactatggggcagaagcaggaagcaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagctcacatcggaccagcacctgaccccgaggactggtggagctacaaggataatctccagggaaacttcgtgccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgcccagtgcttctcgacctggtacattctggttccccgctcgcagacttccgacgtggatggtgtcccccatggtcgctgagactccccttcgaggattgcacccgcccgtcctaagcctccccacaaggcgaggggagttacccctaaaacaaagctattaaagggacagaatacttcc

SEQ ID NO: 357680 - DNA, 2082 bp, Homo sapiens
gcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttaggcctactatggggcagaagcaggaagcaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagctcacatcggaccagcacctgaccccgaggactggtggagctacaaggataatctccagggaaacttcgtgccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatggtatggtccagtctgcaccccctctaagtcttgggctaaccctcttatatgtgtctccccttggtgtctcagtgtgattcagtcccatcctccttcctgcgtctatatggtctagcctcgtgagctgtctctttttctctctttccctacatgtctatgtggtacagtccacctgccagccctaggccattgctagcccacgatttgtctttcctcttcactgctttgtaacttggtctataacccttgacccctgccttcctatggtccaattacctactgttctgtgcttcctattactgtgaatttccaaaatggtacaatttggatcctctctccctttccaagtcgtactaccttacgctgttccaca

SEQ ID NO: 357681 - DNA, 1185 bp, Homo sapiens
cctggccaacttggtgaaacccgtctctgctaaacttggaaactattccaagattcttctaggacccagaattctggatctgagcccagtcctccctcagacccaggagtctaggtccctagcccctcctcccctgggatctgggagtccagaccacagcccactcagcagataccagccctgggatccagtctctatttctgactccttgtcctcctactccgaccccacccccagggccggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgtggatggtgtcccccatggtcgctgagactccccttcgaggattgcacccgcccgtcctaagcctccccacaaggcgaggggagttacccctaaaacaaagctattaaagggacagaatacttcc

SEQ ID NO: 357682 - DNA, 1588 bp, Homo sapiens
gcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttaggcctactatggggcagaagcaggaagcaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagctcacatcggaccagcacctgaccccgaggactggtggagctacaaggataatctccagggaaacttcgtgccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctaagttcagaaccaggggggatccttagagcgacc

SEQ ID NO: 357683 - DNA, 1212 bp, Homo sapiens
gcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttaggcctactatggggcagaagcaggaagcaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgtggatggtgtcccccatggtcgctgagactccccttcgaggattgcacccgcccgtcctaagcctccccacaaggcgaggggagttacccctaaaacaaagctattaaagggacagaatacttcc

SEQ ID NO: 357684 - DNA, 2024 bp, Homo sapiens
ttttttgcgatggagtctcgctctgtggcccaggctggagtgcagtggtatgatctcggtttactgcaacctctgcttcccaattcaagctatcctcctgcttcagcctccggagtagctgggattaggggcacgcaccaccgtgcctggctttttgtatttttagtagagactgggtttcgccatgttggccaggctggtctcgaactcctgacctcaagtgatccaccagccttggcttcccaaagggctgggattacaggcgtgccaccgcacccggcccttccctcacattcttttgtgataaggcccactaactccaaagccaaaattcctagttgcccagaaaatcgagttcccctatccttcagggcagggatggcttcgtcctgggacgtgagtgcaaaatatctgggctctgtgctaccagtgctgccaggaaggagagggcaaaactgcgtttccattggaaagcaatgccagtgttcctgacgtgctgcatacatgtgagcagccgacacctcccacacggtcacaaggcactggctctaagcgaatttgctcagctcccaccagctgctactggtgtttagttctgtggtttgtgcattttgtggttgacatactaaggcacagaggttgagtcagttgtccaaactcactcagctatgaagtagataagcctggatccaaactgcatgagggaccgtgagtccatgccccgcacgccccactcactgcccctcgggtcacaggatgaggaccaggcacatgcagggctggctagaggccgttctgtccagcctgtccaaggtcagccgcaaggcccacccactctggcaggaaggccgcttacggcctaaagaccacgttgaaaggggagttgggcagggtgaagttggccaggtagacagtgtccccgcccgcgaggtacgcggcccagaccccgaaggtgcccacggtgatgatggtgtggttgcactgtgtgagcagtgcgaagtccttggcaggtgagccctggaggccattgccagcgaacaccacgtccccaagggagctgttgatgctctcccggcaccaggccatgtcatcgctggtgaccacaaagaccgggaggcggcagcaggcccggaaccagtccagggcccgctgcaggtagccggtcggccagcacccccttccatacgcgcggcatgacacggacatagtccccccggcgcacgtggacccccacgaaggtcgcctgccctgcccacttggcctgcaggccccgcaggaacttctgggcctcctcgcgcacgtggtcgtgcagggtgaactcctggaggatctcctggcggaggttggtggtagaaggtccaggagcaggggtagcccgtgaggcggacacagcgcccccgggatgtggcggtactcctcctccatccagtcgttcaggtggtagttctgccaggggatcctgctggccgtggcgctgtgcagcaccggcagggtgattctgaagatgggggccagggtgctgtgcatctgggccgggatgaaggcgggccgcccgttcatcttggccagggcgtacagcgtggcgtactcgcccatctggttccccaggcggcccttggagttgatagtgaacaggtcctcccggggcaggtgtctgggggccaggaccacacgggctgagtatgcccagggcgcaggcaccagagccaggtgctggtggcagtgaaagatggtggacaccacaaaaatggcaaagacgaagtagaaggtggagaaggaagggcgggtggcccagaatcccttgacggcttaaggctcggtgaacccacagctgacaaaaggttccagagaggaggaggaggggctggcttggggtcacgcagccagaggcaggggctgagcaaagtttccaacagcgattgtctcccaaaggtcagcccctgcccgatcgcgatggcggccaccacaaggcggggctgagccagtgggcaggggtggagtgggatggagcgggacccccgact

SEQ ID NO: 357685 - DNA, 1305 bp, Homo sapiens
gcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttaggcctactatggggcagaagcaggaagcaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagctcacatcggaccagcacctgaccccgaggactggtggagctacaaggataatctccagggaaacttcgtgccaggtgccgccaaggcggggacccaggagtccggccctcccggcgcctccttcttcagactcaggaacctgggttcccagctccctcctcccccccaggaccaggagtcccagccccctcctctgtccctcaggagtcgggccagcttctgaaccccaggggctcaccatgggacattatacatgcgcatttcaagtagtgagtgggagtgagtggaaggaaagtgtgggggtggagattatgtgtgtgtttgccgggagaggaaggtcctggctcctgctaggaaccagaggctgggtggccccgtcccccaccttgtccagccttctcttgcagctcctctccccaacacattaataataatccagctgtgggataagagcgattaaaaaaaagaactacaactcccacggggctc

SEQ ID NO: 357686 - DNA, 2010 bp, Homo sapiens
ttttttgcgatggagtctcgctctgtggcccaggctggagtgcagtggtatgatctcggtttactgcaacctctgcttcccaattcaagctatcctcctgcttcagcctccggagtagctgggattaggggcacgcaccaccgtgcctggctttttgtatttttagtagagactgggtttcgccatgttggccaggctggtctcgaactcctgacctcaagtgatccaccagccttggcttcccaaagggctgggattacaggcgtgccaccgcacccggcccttccctcacattcttttgtgataaggcccactaactccaaagccaaaattcctagttgcccagaaaatcgagttcccctatccttcagggcagggatggcttcgtcctgggacgtgagtgcaaaatatctgggctctgtgctaccagtgctgccaggaaggagagggcaaaactgcgtttccattggaaagcaatgccagtgttcctgacgtgctgcatacatgtgagcagccgacacctcccacacggtcacaaggcactggctctaagcgaatttgctcagctcccaccagctgctactggtgtttagttctgtggtttgtgcattttgtggttgacatactaaggcacagaggttgagtcagttgtccaaactcactcagctatgaagtagataagcctggatccaaactgcatgagggaccgtgagtccatgccccgcacgccccactcactgcccctcgggtcacaggatgaggaccaggcacatgcagggctggctagaggccgttctgtccagcctgtccaaggtcagccgcaaggcccacccactctggcaggaaggccgcttacggcctaaagaccacgttgaaaggggagttgggcagggtgaagttggccaggtagacagtgtccccgcccgcgaggtacgcggcccagaccccgaaggtgcccacggtgatgatggtgtggttgcactgtgtgagcagtgcgaagtccttggcaggtgagccctggaggccattgccagcgaacaccacgtccccaagggagctgttgatgctctcccggcaccaggccatgtcatcgctggtgaccacaaagaccgggaggcggcagcaggcccggaaccagtccagggcccgctgcaggtagccggtcggccagcacccccttccatacgcgcggcatgacacggacatagtccccccggcgcacgtggacccccacgaaggtcgcctgccctgcccacttggcctgcaggccccgcaggaacttctgggcctcctcgcgcacgtggtcgtgcagggtgaactcctggaggatctcctggcggaggttggtggtagaaggtccaggagcaggggtagcccgtgaggcggacacagcgcccccgggatgtggcggtactcctcctccatccagtcgttcaggtggtagttctgccaggggatcctgctggccgtggcgctgtgcagcaccggcagggtgattctgaagatgggggccagggtgctgtgcatctgggccgggatgaaggcgggccgcccgttcatcttggccagggcgtacagcgtggcgtactcgcccatctggttccccaggcggcccttggagttgatagtgaacaggtcctcccggggcaggtgtctgggggccaggaccacacgggctgagtatgcccagggcgcaggcaccagagccaggtgctggtggcagtgaaagatggtggacaccacaaaaatggcaaagacgaagtagaaggtggagaaggaagggcgggtggcccagaatcccttgacggtggatggtgtcccccatggtcgctgagactccccttcgaggattgcacccgcccgtcctaagcctccccacaaggcgaggggagttacccctaaaacaaagctattaaagggacagaatacttcctgttttctcagtggtctgattctaggcgcggtggggaaacatttgggtattaaagaacagacttcttccggaaacca

SEQ ID NO: 357687 - DNA, 1882 bp, Homo sapiens
ttttttgcgatggagtctcgctctgtggcccaggctggagtgcagtggtatgatctcggtttactgcaacctctgcttcccaattcaagctatcctcctgcttcagcctccggagtagctgggattaggggcacgcaccaccgtgcctggctttttgtatttttagtagagactgggtttcgccatgttggccaggctggtctcgaactcctgacctcaagtgatccaccagccttggcttcccaaagggctgggattacaggcgtgccaccgcacccggcccttccctcacattcttttgtgataaggcccactaactccaaagccaaaattcctagttgcccagaaaatcgagttcccctatccttcagggcagggatggcttcgtcctgggacgtgagtgcaaaatatctgggctctgtgctaccagtgctgccaggaaggagagggcaaaactgcgtttccattggaaagcaatgccagtgttcctgacgtgctgcatacatgtgagcagccgacacctcccacacggtcacaaggcactggctctaagcgaatttgctcagctcccaccagctgctactggtgtttagttctgtggtttgtgcattttgtggttgacatactaaggcacagaggttgagtcagttgtccaaactcactcagctatgaagtagataagcctggatccaaactgcatgagggaccgtgagtccatgccccgcacgccccactcactgcccctcgggtcacaggatgaggaccaggcacatgcagggctggctagaggccgttctgtccagcctgtccaaggtcagccgcaaggcccacccactctggcaggaaggccgcttacggcctaaagaccacgttgaaaggggagttgggcagggtgaagttggccaggtagacagtgtccccgcccgcgaggtacgcggcccagaccccgaaggtgcccacggtgatgatggtgtggttgcactgtgtgagcagtgcgaagtccttggcaggtgagccctggaggccattgccagcgaacaccacgtccccaagggagctgttgatgctctcccggcaccaggccatgtcatcgctggtgaccacaaagaccgggaggcggcagcaggcccggaaccagtccagggcccgctgcaggtagccggtcggccagcacccccttccatacgcgcggcatgacacggacatagtccccccggcgcacgtggacccccacgaaggtcgcctgccctgcccacttggcctgcaggccccgcaggaacttctgggcctcctcgcgcacgtggtcgtgcagggtgaactcctggaggatctcctggcggaggttggtggtagaaggtccaggagcaggggtagcccgtgaggcggacacagcgcccccgggatgtggcggtactcctcctccatccagtcgttcaggtggtagttctgccaggggatcctgctggccgtggcgctgtgcagcaccggcagggtgattctgaagatgggggccagggtgctgtgcatctgggccgggatgaaggcgggccgcccgttcatcttggccagggcgtacagcgtggcgtactcgcccatctggttccccaggcggcccttggagttgatagtgaacaggtcctcccggggcaggtgtctgggggccaggaccacacgggctgagtatgcccagggcgcaggcaccagagccaggtgctggtggcagtgaaagatggtggacaccacaaaaatggcaaagacgaagtagaaggtggagaaggaagggcgggtggcccagaatcccttgacgggcacgtgaactttttctttttttttttttctctccttctcccatattttttcttctttttattctctttttttc

SEQ ID NO: 357688 - DNA, 728 bp, Homo sapiens
gcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttaggcctactatggggcagaagcaggaagcaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggattgcacccgcccgtcctaagcctccccacaaggcgaggggagttacccctaaaacaaagctattaaagggacagaatacttcc

SEQ ID NO: 357689 - DNA, 376 bp, Homo sapiens
tgctcccaggggcggggtttcctgcgtgacgtcaccaagaccattcactattcactcccagtttcccaccctccttccactgcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgtggatggtgtcccccatggtcgctgagactccccttcgaggattgcacccgcccgtcctaagcctccccacaaggcgaggggagttacccctaaaacaaagctattaaagggacagaatacttcc

SEQ ID NO: 357690 - DNA, 624 bp, Homo sapiens
tgctcccaggggcggggtttcctgcgtgacgtcaccaagaccattcactattcactcccagtttcccaccctccttccactgcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatggtatggtccagtctgcaccccctctaagtcttgggctaaccctcttatatgtgtctccccttggtgtctcagtgtgattcagtcccatcctccttcctgcgtctatatggtctagcctcgtgagctgtctctttttctctctttccctacatgtctatgtggtacagtccacctgccagccctaggccattgctagcccacgatttgtctttcctcttcactgctttgtaacttggtctataacccttgacccctgccttcctatggtccaattacctactgttctgtgcttcctattactgtgaatttccaaaatggtacaatttggatcctctctccctttccaagtcgtactaccttacgctgttccaca

SEQ ID NO: 357691 - DNA, 1982 bp, Homo sapiens
taagtgtgcccatggcagcttgtgtatgcatatgtgcatgtatggatatgcatgtttgttggcagggatctgtgcacatttgtaggtctgcctttctacccgtcttgtgttctggactgtgcacatatctgccttgacagacttatcaatgttcacacactggctacacctgtaccttgtctatatgtgtggctgcgtgcgtgagtctgctggagctcagcacttgtgtggctgagctgtttacacctgtctgaatatgaggggtgtgttcatgtgtcccctgaacgcacactagtgcatgtgtcccttctgtgtgtgtcaaggcaggccgcacggccatgaggaccatagcccaggccttggaagttttccacgagcttagactccagcacccactgcacatggcaaatggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagctcacatcggaccagcacctgaccccgaggactggtggagctacaaggataatctccagggaaacttcgtgccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgtggatggtgtcccccatggtcgctgagactccccttcgaggattgcacccgcccgtcctaagcctccccacaaggcgaggggagttacccctaaaacaaagctattaaagggacagaatacttcctgttttctcagtggtctgattctaggcgcggtggggaaacatttgggtattaaagaacagacttcttccggaaacca

SEQ ID NO: 357692 - DNA, 2293 bp, Homo sapiens
gcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttaggcctactatggggcagaagcaggaagcaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagctcacatcggaccagcacctgaccccgaggactggtggagctacaaggataatctccagggaaacttcgtgccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgcccagtgcttctcgacctggtacattctggttccccgctcgcagacttccgacgtggatggtgtcccccatggtcgctgagactccccttcgaggattgcacccgcccgtcctaagcctccccacaaggcgaggggagttacccctaaaacaaagctattaaagggacagaatacttccaaaaaaaaaaaaaaaaaaaaaaaaaaacacattgtgtgcgggcgcgcgcgcccgggcgcctcccggaaagagtttttcataagacacacaatcgcggtgggggcgcgcgggggcgcccaaaaggtgaaagggcgacagtgggggccaaacacgcgtgtgtgcccaaaggaaaaaccgggggccaaggacaaagaggggcggggatattcctccaacacaatataaaaaagaggccggcgggggacaacacgcgagagcggttttgcggaaaaataatcccagagagggggactccggggagagggtcctataagagggggagaatccaaaacaagcgggggagatccccaagaggcgaaccccgcaaatctccaaaatatcagccccccacgcgggggcacagag

SEQ ID NO: 357693 - DNA, 1813 bp, Homo sapiens
gcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttaggcctactatggggcagaagcaggaagcaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagctcacatcggaccagcacctgaccccgaggactggtggagctacaaggataatctccagggaaacttcgtgccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgtggatggtgtcccccatggtcgctgagactccccttcgaggattgcacccgcccgtcctaagcctccccacaaggctgtcggcatagtcgggggatcctcaagg

SEQ ID NO: 357694 - DNA, 999 bp, Homo sapiens
agagactgaaacagggagaagaggcaggagaggaggaggtggggagagcacgaagggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgtggatggtgtcccccatggtcgctgagactccccttcgaggattgcacccgcccgtcctaagcctccccacaaggcgaggggagttacccctaaaacaaagctattaaagggacagaatacttcc

SEQ ID NO: 357695 - DNA, 1382 bp, Homo sapiens
gcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttaggcctactatggggcagaagcaggaagcaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagctcacatcggaccagcacctgaccccgaggactggtggagctacaaggataatctccagggaaacttcgtgccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctacccattcctcagtcgcatcctaacgcgcagttgaaaacgacggtaactcta

SEQ ID NO: 357696 - DNA, 2020 bp, Homo sapiens
cgagcacgacaactgggggccaacgcccctgggggtttatgtggtatgatctcggtttactgcaacctctgcttcccaattcaagctatcctcctgcttcagcctccggagtagctgggattaggggcacgcaccaccgtgcctggctttttgtatttttagtagagactgggtttcgccatgttggccaggctggtctcgaactcctgacctcaagtgatccaccagccttggcttcccaaagggctgggattacaggcgtgccaccgcacccggcccttccctcacattcttttgtgataaggcccactaactccaaagccaaaattcctagttgcccagaaaatcgagttcccctatccttcagggcagggatggcttcgtcctgggacgtgagtgcaaaatatctgggctctgtgctaccagtgctgccaggaaggagagggcaaaactgcgtttccattggaaagcaatgccagtgttcctgacgtgctgcatacatgtgagcagccgacacctcccacacggtcacaaggcactggctctaagcgaatttgctcagctcccaccagctgctactggtgtttagttctgtggtttgtgcattttgtggttgacatactaaggcacagaggttgagtcagttgtccaaactcactcagctatgaagtagataagcctggatccaaactgcatgagggaccgtgagtccatgccccgcacgccccactcactgcccctcgggtcacaggatgaggaccaggcacatgcagggctggctagaggccgttctgtccagcctgtccaaggtcagccgcaaggcccacccactctggcaggaaggccgcttacggcctaaagaccacgttgaaaggggagttgggcagggtgaagttggccaggtagacagtgtccccgcccgcgaggtacgcggcccagaccccgaaggtgcccacggtgatgatggtgtggttgcactgtgtgagcagtgcgaagtccttggcaggtgagccctggaggccattgccagcgaacaccacgtccccaagggagctgttgatgctctcccggcaccaggccatgtcatcgctggtgaccacaaagaccgggaggcggcagcaggcccggaaccagtccagggcccgctgcaggtagccggtcggccagcacccccttccatacgcgcggcatgacacggacatagtccccccggcgcacgtggacccccacgaaggtcgcctgccctgcccacttggcctgcaggccccgcaggaacttctgggcctcctcgcgcacgtggtcgtgcagggtgaactcctggaggatctcctggcggaggttggtggtagaaggtccaggagcaggggtagcccgtgaggcggacacagcgcccccgggatgtggcggtactcctcctccatccagtcgttcaggtggtagttctgccaggggatcctgctggccgtggcgctgtgcagcaccggcagggtgattctgaagatgggggccagggtgctgtgcatctgggccgggatgaaggcgggccgcccgttcatcttggccagggcgtacagcgtggcgtactcgcccatctggttccccaggcggcccttggagttgatagtgaacaggtcctcccggggcaggtgtctgggggccaggaccacacgggctgagtatgcccagggcgcaggcaccagagccaggtgctggtggcagtgaaagatggtggacaccacaaaaatggcaaagacgaagtagaaggtggagaaggaagggcgggtggcccagaatcccttgacggcttaaggctcggtgaacccacagctgacaaaaggttccagagaggaggaggaggggctggcttggggtcacgcagccagaggcaggggctgagcaaagtttccaacagcgattgtctcccaaaggtcagcccctgcccgatcgcgatggcggccaccacaaggcggggctgagccagtgggcaggggtggagtgggatggagcgggacccccgact

SEQ ID NO: 357697 - DNA, 765 bp, Homo sapiens
agcgccatccgtaacgagcgccatccgtaacgagcgcctccgtaacgagcgtccgtaacgagcgccctccgtaacgagccctatctcagtggtggtggttggtggtagaaggtccaggagcaggggtagcccgtgaggcggacacagcgcccccgggatgtggcggtactcctcctccatccagtcgttcaggtggtagttctgccaggggatcctgctggccgtggcgctgtgcagcaccggcagggtgattctgaagatgggggccagggtgctgtgcatctgggccgggatgaaggcgggccgcccgttcatcttggccagggcgtacagcgtggcgtactcgcccatctggttccccaggcggcccttggagttgatagtgaacaggtcctcccggggcaggtgtctgggggccaggaccacacgggctgagtatgcccagggcgcaggcaccagagccaggtgctggtggcagtgaaagatggtggacaccacaaaaatggcaaagacgaagtagaaggtggagaaggaagggcgggtggcccagaatcccttgacggtggatggtgtcccccatggtcgctgagactccccttcgaggattgcacccgcccgtcctaagcctccccacaaggcgaggggagttacccctaaaacaaagctattaaagggacagaatacttcctgttttctcagtggtctgattctaggcgcggtggggaaacatttgggtattaaagaacagacttcttccggaaacca

SEQ ID NO: 357698 - DNA, 1587 bp, Homo sapiens
  misc_feature (1560)..(1560): n is a, c, g, or t
  misc_feature (1568)..(1568): n is a, c, g, or t
ctgacttatgaggaagtgctgaagagaaaccatatgcagtatgaaattgtcatcaaagtcaagcccaagcagctggtgcatcattttgagattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcagtcgagacaagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcggatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagacccttcaatttcattcattccatgttgncccagtanagagggacaacttgttgtt

SEQ ID NO: 357699 - DNA, 628 bp, Homo sapiens
tcacaccacagtagacaaatgcctgacatggcacagtaggcaaatgcccgacacatcatgacagggcactgatatgtctgcctgacactccttcctttggttcctagttcctgatgcagacgtcacctggcctggtcaaagtattcagtcctcctggctacagtgaatgactgggcccctctcatgcatgaatacaccaccctagtggagccactcagagctctctctcatacttgttcttttctggtactacagaccaaacggaccctgtgagcatggggctgccagtgaaaggaggatgcctgggaatgaaatcaatagaagagatgcagaaagcctacggaaaaacagcgtgctgatactatttgacacagcaatgattatttcttacctttggcaccttcctgcatttttattctgttcagcctcttctgctgctctcttagcagggcttgctgctgaatctctaaggtgtgatgatctcttggaggatccaggtacataaatttcagatcaactcgtgtttctgaatctggtataaaaaatatgttatataactaagttaaatgttgttttcaaatgggattttgtaaaacttcactgtaagtaacatgagtaacctaatttc

SEQ ID NO: 357700 - DNA, 7262 bp, Homo sapiens
cggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagtttttgaattatttcatcagtgcaatc

SEQ ID NO: 357701 - DNA, 6561 bp, Homo sapiens
cggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacatta

SEQ ID NO: 357702 - DNA, 6996 bp, Homo sapiens
cggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctgg

SEQ ID NO: 357703 - DNA, 7203 bp, Homo sapiens
cggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagtttttgaattatttcatcagtgcaatc

SEQ ID NO: 357704 - DNA, 2059 bp, Homo sapiens
aaaggattcaaaataattttttgtttgcatgtgcattggggggggtttcctcacagaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagtttttgaattatttcatcagtgcaatc

SEQ ID NO: 357705 - DNA, 2076 bp, Homo sapiens
tactacctccatctcctgtacgtgaagatgtcattggatacaatatcacagaagtctgtagatattcatgattctattcaaccaaggtctgtggataacagaccacaagcaccactggtttctgcgtctgctgttaatgaagaagtcagcaaaattaaatctacagcaaccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagtttttgaattatttcatcagtgcaatc

SEQ ID NO: 357706 - DNA, 2080 bp, Homo sapiens
gagttgggagtccaggagggtctggactaatgggaggtggtgcttggggacgaggatgcgtactggaaggtggaccttcccttactttctgttaggttagatcaagctgagtatctgtggctttcttgtaaaactggtctttggggagcattgagttgtaaatcaagtaaaattattgtgactgtgtgtatatgctggggtggtttgttttccaaagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagtttttgaattatttcatcagtgcaatc

SEQ ID NO: 357707 - DNA, 1776 bp, Homo sapiens
tacatagagcattggcctgtggcgcgcacgccatgctagggtgcagatgtaccatgcgcccatacgttcgttgacgctaggaagaatacctggtctggactgtggcttgcattttctctaatgaatgtgctgggtggcgaagccgagcttgtggcttggatcgagagatgcgcaaggacccaagacgtgcatggcggtcagtaatcgtgtggtctatgaaagcacggaggtgctcactccgctctcgctatcatcttgacaacgccccctccgcatgaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagtttttgaattatttcatcagtgcaatc

SEQ ID NO: 357708 - DNA, 6198 bp, Homo sapiens
cggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggaccaaacggaccctgtgagcatggggctgccagtgaaaggaggatgcctgggaatgaaatcaatagaagagatgcagaaagcctacggaaaaacagcgtgctgatactatttgacacagcaatgattatttcttacctttggcaccttcctgcatttttattctgttcagcctcttctgctgctctcttagcagggcttgctgctgaatctctaaggtgtgatgatctcttggaggatccaggtacataaatttcagatcaactcgtgtttctgaatctggtataaaaaatatgttatataactaagttaaatgttgttttcaaatgggattttgtaaaacttcactgtaagtaacatgagtaacctaatttc

SEQ ID NO: 357709 - DNA, 5996 bp, Homo sapiens
  misc_feature (5996)..(5996): n is a, c, g, or t
cggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttgcagaccttttgtccttttttactcgaatttaaaaaattttcaacaggtatttatctgaagtactgggtacaggccagtttttttgttttttgttgttgttgttttttgaataccaccacatgatcatgctcatcagcggatgggatcctctagaacggcgcagacan

SEQ ID NO: 357710 - DNA, 1806 bp, Homo sapiens
cggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaagtaatcttcttgaaaagggggtttggggtgtgtgttaagggaaatgtgtaggaatgagagttttgatgaagaaatgttgaaaggataatatgatttaataagtgtgtcagacacattgtggtaattgtggactttcctcattgtaggtggtaaaattaatttgactctaacctacaagatatctatgaatgatactttgcatttattagcatctcatgagcagtatgatttatagatttcctttggagcgcagatatatttctaaagagggtcataaatgtccgttaaatgttatataggaatttcagttttcttaagattggtttcatagcaaacaagtgacctagtaaggttttctggaatatgactgaaaattttaaaaaatcattaccagttttaaaaatatgattatggtaaaaaaaaaaaagtactgaaattaaatataaaaac

SEQ ID NO: 357711 - DNA, 1710 bp, Homo sapiens
cggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcccttaatccaaagcctaatccagagcaagaccctaactctctttagttctgtgaaggctgagagaggtgagaaagctgcaggagaaaagtttgaagctatcagaggttagttcatgagatcttcggaagactctccagtaacataaaactgtgatacgc

SEQ ID NO: 357712 - DNA, 7089 bp, Homo sapiens
cggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagtttttgaattatttcatcagtgcaatc

SEQ ID NO: 357713 - DNA, 7238 bp, Homo sapiens
cggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttatttatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagtttttgaattatttcatcagtgcaatc

SEQ ID NO: 357714 - DNA, 7221 bp, Homo sapiens
cggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttccactggatgagagcatgcatgccctcatccagtggctcctgccaggaacctagttgggagcaattcctgacaccttccttgacctcctcagaacctgtcaccaagtcctgccgccgaagctgccaattctacctcagaaatatttcatctctccacagcactgtatcatcacggccaacaaccctgtccagctcccctttactcagatcacatatttacgggcatctttactccagcagaaagaacgcaccttgctgttttccctccccctacacacattctgcccctttcattccttcacctc

SEQ ID NO: 357715 - DNA, 7218 bp, Homo sapiens
cggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagtttttgaattatttcatcagtgcaatc

SEQ ID NO: 357716 - DNA, 5885 bp, Homo sapiens
cggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgatacaatatcacagaagtctgtagatattcatgattctattcaaccaaggtctgtggataacagaccacaagcaccactggtttctgcgtctgctgttaatgaagaagtcagcaaaattaaatctacagcaaccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaactt

SEQ ID NO: 357717 - DNA, 6145 bp, Homo sapiens
cggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaactggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggaccaaacggaccctgtgagcatggggctgccagtgaaaggaggatgcctgggaatgaaatcaatagaagagatgcagaaagcctacggaaaaacagcgtgctgatactatttgacacagcaatgattatttcttacctttggcaccttcctgcatttttattctgttcagcctcttctgctgctctcttagcagggcttgctgctgaatctctaaggtgtgatgatctcttggaggatccaggtacataaatttcagatcaactcgtgtttctgaatctggtataaaaaatatgttatataactaagttaaatgttgttttcaaatgggattttgtaaaacttcactgtaagtaacatgagtaacctaatttc

SEQ ID NO: 357718 - DNA, 3879 bp, Homo sapiens
cggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaagggtaaataaggttcaaatgctcattgattgtctgttatatccaaaccactgtgctaggtagcatccagggatttacagataataggacctaatcccctgtttagagaatttagattgtctacaatctggaagtcgtaaaacaaatccataaaaaattgtaatgtgagatacttagagaaataaaagtgctatgggatttgaggtgacttatttaaatgaaactatataaaacagtagaagtttataacatgatacatttatttttccagacaaactctctttgctagtgcggatacagcttatgttttggcttattcaattatcatgttgaccacagaccttcacagtccacaggtatgttttcttttaagtcagttttacaataagcggtacaaaataagtacattattctgaattcagtaagtaatagttgaaattttagttttattcagttaaaccagtcaccatatttgggtatttaatttgggatggtgaacattttacaaaggcaacttctggtagtaattaaaattagacttttaggtatctataaaatgtttctgtatttgtcgttcatgattgacaactgtataaagcttaagataaattttaatctaacaagacatttataggtcttatgtcagtttgtcacaacatggatatgacgtcagagaatataccgcaatccagtgcgacaacaatattgaatcgtcgtacaggactcacgagcagatgtgtagctcatcacagaccatgtaatctccagacacatcctgtatcggagccgactcagagaactagagcggtactcaacagtgaagtcgcaggcagttagtgagccagactttgggcaagcagtgagtgaaaacccctgtctctacaaaatatgcataaattagctgggcatggtggcatgtgcctgtggtcccaactacttggagggctaaggtgggacgatcgcttgagcctgggaggcacaagtcatacagtgagctgaga

SEQ ID NO: 357719 - DNA, 1118 bp, Homo sapiens
ggcttattcaattcacgcaggaaccaatgggcggagacggcagccgcgccgtctgacggcttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaagcgtttttcttctcaacagatgttcctttgagttctttgtgctactactgagtcgctactcgctgatggtcatgcgtcccacgggatccccggacgggctagcgagaatcctcgagggaccacggctctcccggtgtgtatccaccatcggctcgaagaacctttaaccaggcacaaccaccgcgacggactaacagcagacgcagagaagagaaccacctgacagaaaacgccacaaaccacagcaccgacgcagagcgagcgagaaaaaaccagcgacaccaagaacaaaccatctcgaagtcggaaccgcacacccagatcagcactcgacccaacacacgcacaacagcactcacagcccaagcgatagccaaaccaaagcccgcacgacgagcatcgctacgcagacagatggcatcctccagacgccaccaacaaataactcacacacgcacaggagaatttcaaccctaaacccacacgctacgtcacatctcacacaactgcgctcccgaaccaacaagagccacccatcggtacagctgccctaccaaaacctcgcgctcccacccttatccctcacatccactcgtcacaccctactatcgtctcacttgcaaacactcttcccacgtcaccctttcacgtgcacccacaatctcacctcaccccacacccccacacacacacactcatcgtataccacagccttcattcgactagtaacctctcaccaacttctaccaacactcgctagctcccgctaccacattactctgtttcaacattctaccacgctaacgacaccacagtagtgtaaacagcactgagctctatacacaaactcctatttacctaagaatctcaagcatcccata

SEQ ID NO: 357720 - DNA, 400 bp, Homo sapiens
aaaactccgcagactattcttactcataaacatttggtagaaggtattaacaaatggaatcccacaatatatatgaggataaaatcaagatcaaataagtgttcattttttactaataaatttctcaactaatgtttcatttttttgctttatgcttagggctatcgttatcattgatcttgactatagtaggctcaattattgttcccactttgtaagctaaaaaatattacacacattttttcttgcttttttaggagccagagatatcgtcacctgatgacctgataaaatcagatgccaaaagctttaattgatattgcactatgccatcacagtcctatgaaatatgcattaagacatttgagctcacctatgagagatgcgtgtggttctagag

SEQ ID NO: 357721 - DNA, 2491 bp, Homo sapiens
aaaactccgcagactattcttactcataaacatttggtagaaggtattaacaaatggaatcccacaatatatatgaggataaaatcaagatcaaataagtgttcattttttactaataaatttctcaactaatgtttcatttttttgctttatgcttagggctatcgttatcattgatcttgactatagtaggctcaattattgttcccactttgtaagctaaaaaatattacacacattttttcttgcttttttagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcagcctattgaagagatgcgacacacgattgtagatattctaacaatgaagagtcaagaaaaagctaatttaggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggtttttattatttgtggggtgttttgttttgagtagctttatattgctcttaggtctggagttggccatgtacctatgtatcctaagcattcacggcagtgagctcctttactaacattcatgttatggcaagagttgtcctctacattggaaagctaatcctaccttgtcagtttcaaccaactgagttttttctttaagaaaggtaaattttgtcagctagtttactatgttccttgaatataaacaggttataatactaccctgttcactttactaaatataagtacagtaatgatgcataattagaaaatgaggtattctaggtaaaatgtatgtttgccttgacatgtttttaaaagttatgatgtacctccctgcctttaaacagaatacttttttcttttttttggcctttctcagattagtcaaaaattctatagaatgactcacttcgaatactaagacacaggaggtttagcctgctttcttaccaaattcatgttacccagacttgtgttctcttgcgtcccttggactgcctgttgattgatggaaagtgtctgcactgacacttttcgtcagtagtctgtagtttcgtggcctcttttgattataactggggtcaccaagaaggtttacttaattaaataccgcatttctaagagaagatactttgtgtaagaaaagatgccacatttagtggtttaacttttgtaacttcacttgatagtttttaagcaattagaatggagttagggaaagaacatatcatactgaacaaatgtcattctagtttagatagcatttctaagataactgatactaatacttgttttcttccctataacataaaaaacttcactgttaagtcatgtcccttgaaacatgatagttacatacacagttttctctccacacataaataacaccactaaagttgttttgtaaggttccaaactaatatggcatatatcaactctacagtttcaaataaatgactttttaattgtaaaagattagttgaaaaactgtatgaatgtgaagatcacatgcttagtcatttttatgttcattccactttgtatatcttttctatttattgacttctcatgttctagagagtaggacttttattccgtgtacctgatatatatacaattaaaatatctgtataattatgttttaatgaagtttatttcaacagatattttatgaaatgcagtttaaccacagtgaatgaattttagctttgcttttgaaatacattgtaagatttgacttgaggtttttgacacttaagtacatgcttaatgatatattttcaaaagtcatcagtctacttacataaactttacctaatttttttcactttaacaaaaacataactatgcccttgttttttcatactttgacccaaaatatgccattttgaaataaaatttaagctttgaaaaaaaaa

SEQ ID NO: 357722 - DNA, 2287 bp, Homo sapiens
cgcttgtgaagcattccctaaccatctccctataccacaggcaaagttagttgtttctttttgtgggttttaataatcctttgttcttatttcatatatagcatttatttcattttataatagtatttgttatatagttggcagcagtatttgctgaggaaaaggaatggttcagagatggcaatcgtgttcttttattttgaaaatgtggccaactaggaacaactttaatgtcttctgattttgttcttaaaattcagccaaaagcttaatctataaatgtattttctataggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggtttttattatttgtggggtgttttgttttgagtagctttatattgctcttaggtctggagttggccatgtacctatgtatcctaagcattcacggcagtgagctcctttactaacattcatgttatggcaagagttgtcctctacattggaaagctaatcctaccttgtcagtttcaaccaactgagttttttctttaagaaaggtaaattttgtcagctagtttactatgttccttgaatataaacaggttataatactaccctgttcactttactaaatataagtacagtaatgatgcataattagaaaatgaggtattctaggtaaaatgtatgtttgccttgacatgtttttaaaagttatgatgtacctccctgcctttaaacagaatacttttttcttttttttggcctttctcagattagtcaaaaattctatagaatgactcacttcgaatactaagacacaggaggtttagcctgctttcttaccaaattcatgttacccagacttgtgttctcttgcgtcccttggactgcctgttgattgatggaaagtgtctgcactgacacttttcgtcagtagtctgtagtttcgtggcctcttttgattataactggggtcaccaagaaggtttacttaattaaataccgcatttctaagagaagatactttgtgtaagaaaagatgccacatttagtggtttaacttttgtaacttcacttgatagtttttaagcaattagaatggagttagggaaagaacatatcatactgaacaaatgtcattctagtttagatagcatttctaagataactgatactaatacttgttttcttccctataacataaaaaacttcactgttaagtcatgtcccttgaaacatgatagttacatacacagttttctctccacacataaataacaccactaaagttgttttgtaaggttccaaactaatatggcatatatcaactctacagtttcaaataaatgactttttaattgtaaaagattagttgaaaaactgtatgaatgtgaagatcacatgcttagtcatttttatgttcattccactttgtatatcttttctatttattgacttctcatgttctagagagtaggacttttattccgtgtacctgatatatatacaattaaaatatctgtataattatgttttaatgaagtttatttcaacagatattttatgaaatgcagtttaaccacagtgaatgaattttagctttgcttttgaaatacattgtaagatttgacttgaggtttttgacacttaagtacatgcttaatgatatattttcaaaagtcatcagtctacttacataaactttacctaatttttttcactttaacaaaaacataactatgcccttgttttttcatactttgacccaaaatatgccattttgaaataaaatttaagctttgaaaaaaaaa

SEQ ID NO: 357723 - DNA, 1968 bp, Homo sapiens
ggcttattcaattcacgcaggaaccaatgggcggagacggcagccgcgccgtctgacggcttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacctctgccaatgttacaatccggaaagggcctcatgaaaaagaactattacaatcaaaaacagctttatctagtgtcaaaaccagttcttctcaaggtataataagaaataagactctatcaagatccatagcatctgaagttgtagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcaggtaagataaaaatttactgatctttacaattacagtgtagtagacaattcggaattaatttgaaacacatcacaacataacttgagaaaattttctttgtatatgtagtggtaataaatgtttaaaggctgcaaggattgcattataaaagctgtttgttggctttctaagtcttttattcctgtattgggaataatcagattttagaaaatggatataagctgaaatgtatatttaatgaaactttctgcatgaaatgttttagcatattattgtatgcatttcctggttggaagtttactgggagactgaatgtaatattaaaatttgtttattgaatat

SEQ ID NO: 357724 - DNA, 2448 bp, Homo sapiens
ggcttattcaattcacgcaggaaccaatgggcggagacggcagccgcgccgtctgacggcttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacctctgccaatgttacaatccggaaagggcctcatgaaaaagaactattacaatcaaaaacagctttatctagtgtcaaaaccagttcttctcaaggtataataagaaataagactctatcaagatccatagcatctgaagttgtagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcagcctattgaagagatgcgacacacgattgtagatattctaacaatgaagagtcaagaaaaagctaatttaggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgatgttatcgcccaacaccgtggtgaagcaaggcttggagcctccctccttcgtgggctggttccttggctgggatgatgattactggtctgtggaccccttggacagggccatggctgagctggctgcctgaggaggggcagggcccacccatgtcaccggtcagtgcctttgggaactgtccttccctcaaagaggccttagagcgagcagggcagctctgctatgagtgtgtgtgtgtgtgtgtgtgtggtctcttttttttttttaagagtatccaaaaatagcccggaaaaaatccagagtcctcgcaaagtggtctacaggg

SEQ ID NO: 357725 - DNA, 2005 bp, Homo sapiens
ggcttattcaattcacgcaggaaccaatgggcggagacggcagccgcgccgtctgacggcttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacctctgccaatgttacaatccggaaagggcctcatgaaaaagaactattacaatcaaaaacagctttatctagtgtcaaaaccagttcttctcaaggtataataagaaataagactctatcaagatccatagcatctgaagttgtagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcaggtaagataaaaatttactgatctttacaattacagtgtagtagacaattcggaattaatttgaaacacatcacaacataacttgagaaaattttctttgtatatgtagtggtaataaatgtttaaaggctgcaaggattgcattataaaagctgtttgttggctttctaagtcttttattcctgtattgggaataatcagattttagaaaatggatataagctgaaatgtatatttaatgaaactttctgcatgaaatgttttagcatattattgtatgcatttcctggttggaagtttactgggagactgaatgtaatattaaaatttgtttattgaatataaagcaaaagggattaaattcgctttttaaatgttat

SEQ ID NO: 357726 - DNA, 735 bp, Homo sapiens
ctgcttcattgtctaatgataaactgatggaaaagtcagagcccgttgaccagcgaagacatactgcaggaaaagcaattgttgatagtagatcagctcagcccaaagaaacctcggaagagagaaagtaagtagatataattttctttattacattagttttcaataaagtactgtttgtagatttggattataatttccttgactgcattagaattttctttcatggtttctcttctgtcatatgcaggcaaatttatattgtggaacaatatgacctaaaagtttttgtgtttgagtatgttttataaggttgctttttaaaatctaaggtaaatgcttaataataattgggaaatactttataatctcaaatcaaaaaatgcattcatggaatcattgagcataattgacgttgatatgtttaatatttcttcaagcttgtgaactatatatgccattaaagtaagattacttaaaaatatgattttttcttttaactttatttgacagagttctgtcagcaatttcaaagtaacgtttatatctgcttctaactatagagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaac

SEQ ID NO: 357727 - DNA, 3419 bp, Homo sapiens
ggcttattcaattcacgcaggaaccaatgggcggagacggcagccgcgccgtctgacggcttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacctctgccaatgttacaatccggaaagggcctcatgaaaaagaactattacaatcaaaaacagctttatctagtgtcaaaaccagttcttctcaaggtataataagaaataagactctatcaagatccatagcatctgaagttgtagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcagcctattgaagagatgcgacacacgattgtagatattctaacaatgaagagtcaagaaaaagctaatttaggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggtttttattatttgtggggtgttttgttttgagtagctttatattgctcttaggtctggagttggccatgtacctatgtatcctaagcattcacggcagtgagctcctttactaacattcatgttatggcaagagttgtcctctacattggaaagctaatcctaccttgtcagtttcaaccaactgagttttttctttaagaaaggtaaattttgtcagctagtttactatgttccttgaatataaacaggttataatactaccctgttcactttactaaatataagtacagtaatgatgcataattagaaaatgaggtattctaggtaaaatgtatgtttgccttgacatgtttttaaaagttatgatgtacctccctgcctttaaacagaatacttttttcttttttttggcctttctcagattagtcaaaaattctatagaatgactcacttcgaatactaagacacaggaggtttagcctgctttcttaccaaattcatgttacccagacttgtgttctcttgcgtcccttggactgcctgttgattgatggaaagtgtctgcactgacacttttcgtcagtagtctgtagtttcgtggcctcttttgattataactggggtcaccaagaaggtttacttaattaaataccgcatttctaagagaagatactttgtgtaagaaaagatgccacatttagtggtttaacttttgtaacttcacttgatagtttttaagcaattagaatggagttagggaaagaacatatcatactgaacaaatgtcattctagtttagatagcatttctaagataactgatactaatacttgttttcttccctataacataaaaaacttcactgttaagtcatgtcccttgaaacatgatagttacatacacagttttctctccacacataaataacaccactaaagttgttttgtaaggttccaaactaatatggcatatatcaactctacagtttcaaataaatgactttttaattgtaaaagattagttgaaaaactgtatgaatgtgaagatcacatgcttagtcatttttatgttcattccactttgtatatcttttctatttattgacttctcatgttctagagagtaggacttttattccgtgtacctgatatatatacaattaaaatatctgtataattatgttttaatga

SEQ ID NO: 357728 - DNA, 3689 bp, Homo sapiens
ggcttattcaattcacgcaggaaccaatgggcggagacggcagccgcgccgtctgacggcttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacctctgccaatgttacaatccggaaagggcctcatgaaaaagaactattacaatcaaaaacagctttatctagtgtcaaaaccagttcttctcaaggtataataagaaataagactctatcaagatccatagcatctgaagttgtagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcagcctattgaagagatgcgacacacgattgtagatattctaacaatgaagagtcaagaaaaagctaatttaggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggtttttattatttgtggggtgttttgttttgagtagctttatattgctcttaggtctggagttggccatgtacctatgtatcctaagcattcacggcagtgagctcctttactaacattcatgttatggcaagagttgtcctctacattggaaagctaatcctaccttgtcagtttcaaccaactgagttttttctttaagaaaggtaaattttgtcagctagtttactatgttccttgaatataaacaggttataatactaccctgttcactttactaaatataagtacagtaatgatgcataattagaaaatgaggtattctaggtaaaatgtatgtttgccttgacatgtttttaaaagttatgatgtacctccctgcctttaaacagaatacttttttcttttttttggcctttctcagattagtcaaaaattctatagaatgactcacttcgaatactaagacacaggaggtttagcctgctttcttaccaaattcatgttacccagacttgtgttctcttgcgtcccttggactgcctgttgattgatggaaagtgtctgcactgacacttttcgtcagtagtctgtagtttcgtggcctcttttgattataactggggtcaccaagaaggtttacttaattaaataccgcatttctaagagaagatactttgtgtaagaaaagatgccacatttagtggtttaacttttgtaacttcacttgatagtttttaagcaattagaatggagttagggaaagaacatatcatactgaacaaatgtcattctagtttagatagcatttctaagataactgatactaatacttgttttcttccctataacataaaaaacttcactgttaagtcatgtcccttgaaacatgatagttacatacacagttttctctccacacataaataacaccactaaagttgttttgtaaggttccaaactaatatggcatatatcaactctacagtttcaaataaatgactttttaattgtaaaagattagttgaaaaactgtatgaatgtgaagatcacatgcttagtcatttttatgttcattccactttgtatatcttttctatttattgacttctcatgttctagagagtaggacttttattccgtgtacctgatatatatacaattaaaatatctgtataattatgttttaatgaagtttatttcaacagatattttatgaaatgcagtttaaccacagtgaatgaattttagctttgcttttgaaatacattgtaagatttgacttgaggtttttgacacttaagtacatgcttaatgatatattttcaaaagtcatcagtctacttacataaactttacctaatttttttcactttaacaaaaacataactatgcccttgttttttcatactttgacccaaaatatgccattttgaaataaaatttaagctttgaaaaaaaaa

SEQ ID NO: 357729 - DNA, 2241 bp, Homo sapiens
gtgcccagccaagacagccatttttcaatcttaattgtaagtggtctgagaagcatggtttaagagccactcttactttaaaatacagtatgaaaatttaatcgcgacttggatacctagttaatgtcagagaaaataaaacttacatggatctgctttcttcattaaaaaaattaagcctattgaagagatgcgacacacgattgtagatattctaacaatgaagagtcaagaaaaagctaatttaggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggtttttattatttgtggggtgttttgttttgagtagctttatattgctcttaggtctggagttggccatgtacctatgtatcctaagcattcacggcagtgagctcctttactaacattcatgttatggcaagagttgtcctctacattggaaagctaatcctaccttgtcagtttcaaccaactgagttttttctttaagaaaggtaaattttgtcagctagtttactatgttccttgaatataaacaggttataatactaccctgttcactttactaaatataagtacagtaatgatgcataattagaaaatgaggtattctaggtaaaatgtatgtttgccttgacatgtttttaaaagttatgatgtacctccctgcctttaaacagaatacttttttcttttttttggcctttctcagattagtcaaaaattctatagaatgactcacttcgaatactaagacacaggaggtttagcctgctttcttaccaaattcatgttacccagacttgtgttctcttgcgtcccttggactgcctgttgattgatggaaagtgtctgcactgacacttttcgtcagtagtctgtagtttcgtggcctcttttgattataactggggtcaccaagaaggtttacttaattaaataccgcatttctaagagaagatactttgtgtaagaaaagatgccacatttagtggtttaacttttgtaacttcacttgatagtttttaagcaattagaatggagttagggaaagaacatatcatactgaacaaatgtcattctagtttagatagcatttctaagataactgatactaatacttgttttcttccctataacataaaaaacttcactgttaagtcatgtcccttgaaacatgatagttacatacacagttttctctccacacataaataacaccactaaagttgttttgtaaggttccaaactaatatggcatatatcaactctacagtttcaaataaatgactttttaattgtaaaagattagttgaaaaactgtatgaatgtgaagatcacatgcttagtcatttttatgttcattccactttgtatatcttttctatttattgacttctcatgttctagagagtaggacttttattccgtgtacctgatatatatacaattaaaatatctgtataattatgttttaatgaagtttatttcaacagatattttatgaaatgcagtttaaccacagtgaatgaattttagctttgcttttgaaatacattgtaagatttgacttgaggtttttgacacttaagtacatgcttaatgatatattttcaaaagtcatcagtctacttacataaactttacctaatttttttcactttaacaaaaacataactatgcccttgttttttcatactttgacccaaaatatgccattttgaaataaaatttaagctttgaaaaaaaaa

SEQ ID NO: 357730 - DNA, 2228 bp, Homo sapiens
ggcttattcaattcacgcaggaaccaatgggcggagacggcagccgcgccgtctgacggcttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacctctgccaatgttacaatccggaaagggcctcatgaaaaagaactattacaatcaaaaacagctttatctagtgtcaaaaccagttcttctcaaggtataataagaaataagactctatcaagatccatagcatctgaagttgtagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcagcctattgaagagatgcgacacacgattgtagatattctaacaatgaagagtcaagaaaaagctaatttaggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatgggg

SEQ ID NO: 357731 - DNA, 2882 bp, Homo sapiens
ggcttattcaattcacgcaggaaccaatgggcggagacggcagccgcgccgtctgacggcttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacctctgccaatgttacaatccggaaagggcctcatgaaaaagaactattacaatcaaaaacagctttatctagtgtcaaaaccagttcttctcaaggtataataagaaataagactctatcaagatccatagcatctgaagttgtagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcagcctattgaagagatgcgacacacgattgtagatattctaacaatgaagagtcaagaaaaagctaatttaggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggaaaaaaaaaaaaaaaaaaaaaaaaaaaaaaaaaaaaaaaaaaaaaaacaaaaacaaaaaaaacaaaacaagaggggggggccgccacaaagaaatacccccgagaggagggcccccaatgttagccagcaccccacacttcgttgagcacaacaaggtgggcccccaaagtaggcggcgagctgctattaaaaagaccgagaagacgacggggcgcggccacgtataaaacaaaacgcctgcaggaaagcaggagaaacacagcgcgccccacacgtcgagggaaattctctggagagaagagacacacaccacctcaaaagcagagcgggggggagcgacaaccaaactcagccggcgccaacaacaacccacacatcccatatacgaagaaaaatatttatcttcataacgccgccccacatacagagcggcaacaaatcaaactataatacaacagcctctttatcgcccagcgaacgctgtcatatactaatgtcgcgggtggttcgcaccaacaactcagacgcctgccgcataattaagttgacgacgcgcgtagtcgtctatcagaaagaacaatgtcgcgcttgcacacaactcgcgggctagcatcatacattgttaccaggaagacacttatttttttctaccg

SEQ ID NO: 357732 - DNA, 490 bp, Homo sapiens
gagaaaagctttgttaatgaaagattttgtgatagagctgatgcttatacatctattctataacagtgatgaatattaacacaaaggaaatatggagaactgttataactgagtgttagaacagtcgtgtacattgatcagtattgagtccatttttaggatggattagtcagttcttttcattggtcttgaaagtaattttggctggtcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaa

SEQ ID NO: 357733 - DNA, 2080 bp, Homo sapiens
ataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaacagttaaactatgaaccaagttttatggggtttaagtcatgtttttagaattgcaaattaaattatttgttcaccattcctattgctatcttttatagataacattcttgggatcttttatagcattcttgggcacaagggattaaatacaacttttatatacagaggatctttacatgtttattaaatctgaatttgaagatacattccaatcttgcataaagtgtttgttgggcttttacattacgtaattaaaaaacaaaattttttaaccaattttatgtgccatgtcacgtttaatgctatcttgtgtgaccagatcccaccagtaatgacaaaactgtcttaaacctcatttttttttttttttgagacaagagtttcactcttgttgcccaaacgagagcaatggcaccatctcgactcactgcaacctctgcctcccaggttcaagcaattctcctgcctcagcctcccaagtagctgggattacacgcatgcgccaccatgcctggctacttttgtatttttaatagagacagggtttcttcatgttggtcaagctggtcatgaactcccaacctcaagtgatccgcccacctcggcctcccaaagtgctgggattacaggcatgagccaccgtgcccagcccttaaatctcatttttaagaaaccctcacctattctgtagtcagctaagcttttaattacattaattttaagcacttgagaataaaatgactgcatttatcatccaagtgtcaaacaattaaaaacctaaaaagggtaactatatataagctgaggtaatatgggcttgataaagcccatgaggtaaatatgaacactaaacttggttttaattctaacagactatatctaaacctgtaagcagtatactcctaacagtaccctcataaattctgaatataattcttgtttgctgcagtcaatatttggcagtttaaattagcacagacgttgaggccttgctgagttattaggctatgtaaaagaggttaaaaatatgatcattctttattgttaattggtaatattttctcatacattaggtaaatgtcaagctttgggtctctggagtataactttttgtaacattagccattatttggtaacagaatttaaggatgatggaatgatggaaggtattacatatttctaaaacttaattaagctctaggtcagataacaatggagtaaagtgatacctgcatttttttccccagtgtaatcttaatttactattgtatttttcacttaaaattttgtagggaaaaaaagttttcaagggaacactaagattaaattgactaggttcaaatatgcttccttatgagattcaaaatttactgtgtgaaattaaagtttaagagacctaaaaaaatgtactcccataaagaatcaatactgcttc

SEQ ID NO: 357734 - DNA, 888 bp, Homo sapiens
ataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaacagttaaactatgaaccaagttttatggggtttaagtcatgtttttagaattgcaaattaaattatttgttcaccattcctattgctatcttttatagataacattcttgggatcttttatagcattcttgggcacaagggattaaatacagtttttttacgagggcctacggtttttagcggattgaagacttccagctgcaaaggtggggggtaccacgcattgtttggcacgtgtgccgc

SEQ ID NO: 357735 - DNA, 1570 bp, Homo sapiens
ataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcagggcttctcaaatttaataactatggaatcttatcagaaagtccattaacatctcaaagaacaacgtggttattgtatcaatcaccatcctttataccaggatttgcatatccttcaagatgcctgaagacaatcggaggggtatacaagcaagcgaggttaagaacaatcacttttcagatcctaaacttttatatgtagtgtctgctgataatgcattccctgagaaaatggacctgtggataaaccatcatgcttcatctcatttcctgtctcctctttcaccatttttctttcttttcttttcttttttttttttttttcttgagacaagctcttactctgtcacctaagctagaatgcagtggcgtgatcatatctcactgcaacctaaaactcaggctcaagcagtaccctcacctcagcctcccgagtagctgagactaacaggcacactccatcatgcccgaataatttttgttaattttttgtagagatgaggtcttgctttgttgtctaggctggtcttgaactgggctcaagcgatcctcccactttggccttccaaagtgctgggattccagatgcgagccaccgcaccagtcccccaattatttttctaaggatgtatgaaggaaaggcatctctctagcctggtagaatcttactatgacaaaaatgctccagaaaataaacatctcttaggagctacacacagagacaaggaaacactggtaactcaagaaagactaagggcttcgctaattattaagtaagtagtgcttctgcaagtcaagagactgttctcagctttcaacaatactgaaggaatacctaattgagtagtctgctggtcatttaaaattatttcttgatgataggtcactacgtgattgttagcatataacgtaagttcaaagattgaaaaaaattttcccattttcatctcagtgtttacatctacaaaaatgaagaatagggctgggcacagtggctcacgcctgtaatcccagcactttgggaggccaacgggggcggatcacttgaggtcagaagttcgagaccagcctggccaacatggtgaaaccctgtctctactgaaaatacaaagattggccgggcatggtggcatgcgcctgtggtcccggctactcgggagtctcaggcaggagaattgcttgaatccaggtggcggaggttgcagtgagccgagatcgtgccactgcaccccagcctgggcaacagagcaagactccatctcaaaaaaaaaggaagaagaatagaattgtagcaataagtaaatttcagccatgtatatacgtgaactaattgagaaaataaagctgtcttcttattaacag

SEQ ID NO: 357736 - DNA, 579 bp, Homo sapiens
ataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaataca

SEQ ID NO: 357737 - DNA, 582 bp, Homo sapiens
ggaccgtctagaaaagcatctgtgtttggaaagggaccattctacagcttagtccagaacaccttgaacacacagcatagcagaatcttgactgtaatacttggagcaaatgtcactggcaaaaatggcatatatgctgggatgttcataacaaatagttaaatattgttggtcctttcgcatatagaatctcggtattagaggaaaatagtaaactgaaactctatttctgttctgcaagagccaatttcacctattgtattacttcgttaccaattgcagctgtgtagtcagtcatccataggattctttttgttagacacaaagtagaaaccagctgttggccgttgagacaagtaggaatcttaggaaatgttagcctgccagttcctacttttcctaactacctgcctcaccacccccatcaaatggtggtcatgttttttgtcacccaccattcaggggagatgctatcaacgaaccacgctggctacacacaaataccttttcctcagatgatattaatcatctttgccttaaaaactgaagctctaccaagttttcactatgagagaaaaaaaa

SEQ ID NO: 357738 - DNA, 676 bp, Homo sapiens
ataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagagaagggatctcaatgtgttgcctaggctggtctcaaacccctgggctcaaacaaacaatccaacccctttggcatcccaaagtgctgggataacagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaataca

SEQ ID NO: 357739 - DNA, 2026 bp, Homo sapiens
ataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaacagttaaactatgaaccaagttttatggggtttaagtcatgtttttagaattgcaaattaaattatttgttcaccattcctattgctatcttttatagataacattcttgggatcttttatagcattcttgggcacaagggattaaatacaacttttatatacagaggatctttacatgtttattaaatctgaatttgaagatacattccaatcttgcataaagtgtttgttgggcttttacattacgtaattaaaaaacaaaattttttaaccaattttatgtgccatgtcacgtttaatgctatcttgtgtgaccagatcccaccagtaatgacaaaactgtcttaaacctcatttttttttttttttgagacaagagtttcactcttgttgcccaaacgagagcaatggcaccatctcgactcactgcaacctctgcctcccaggttcaagcaattctcctgcctcagcctcccaagtagctgggattacacgcatgcgccaccatgcctggctacttttgtatttttaatagagacagggtttcttcatgttggtcaagctggtcatgaactcccaacctcaagtgatccgcccacctcggcctcccaaagtgctgggattacaggcatgagccaccgtgcccagcccttaaatctcatttttaagaaaccctcacctattctgtagtcagctaagcttttaattacattaattttaagcacttgagaataaaatgactgcatttatcatccaagtgtcaaacaattaaaaacctagtaaatatgaacactaaacttggttttaattctaacagactatatctaaacctgtaagcagtatactcctaacagtaccctcataaattctgaatataattcttgtttgctgcagtcaatatttggcagtttaaattagcacagacgttgaggccttgctgagttattaggctatgtaaaagaggttaaaaatatgatcattctttattgttaattggtaatattttctcatacattaggtaaatgtcaagctttgggtctctggagtataactttttgtaacattagccattatttggtaacagaatttaaggatgatggaatgatggaaggtattacatatttctaaaacttaattaagctctaggtcagataacaatggagtaaagtgatacctgcatttttttccccagtgtaatcttaatttactattgtatttttcacttaaaattttgtagggaaaaaaagttttcaagggaacactaagattaaattgactaggttcaaatatgcttccttatgagattcaaaatttactgtgtgaaattaaagtttaagagacctaaaaaaatgtactcccataaagaatcaatactgcttc

SEQ ID NO: 357740 - DNA, 1987 bp, Homo sapiens
ataatggcaaaaggagattcctggcttcctgtttccagggtgacgtagatttttttccttcgccagtctcaccgttacccggggcaacagctgagccgtctgggaagggatgcatctgaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaacagttaaactatgaaccaagttttatggggtttaagtcatgtttttagaattgcaaattaaattatttgttcaccattcctattgctatcttttatagataacattcttgggatcttttatagcattcttgggcacaagggattaaatacaacttttatatacagaggatctttacatgtttattaaatctgaatttgaagatacattccaatcttgcataaagtgtttgttgggcttttacattacgtaattaaaaaacaaaattttttaaccaattttatgtgccatgtcacgtttaatgctatcttgtgtgaccagatcccaccagtaatgacaaaactgtcttaaacctcatttttttttttttttgagacaagagtttcactcttgttgcccaaacgagagcaatggcaccatctcgactcactgcaacctctgcctcccaggttcaagcaattctcctgcctcagcctcccaagtagctgggattacacgcatgcgccaccatgcctggctacttttgtatttttaatagagacagggtttcttcatgttggtcaagctggtcatgaactcccaacctcaagtgatccgcccacctcggcctcccaaagtgctgggattacaggcatgagccaccgtgcccagcccttaaatctcatttttaagaaaccctcacctattctgtagtcagctaagcttttaattacattaattttaagcacttgagaataaaatgactgcatttatcatccaagtgtcaaacaattaaaaacctaaaaagggtaactatatataagctgaggtaatatgggcttgataaagcccatgaggtaaatatgaacactaaacttggttttaattctaacagactatatctaaacctgtaagcagtatactcctaacagtaccctcataaattctgaatataattcttgtttgctgcagtcaatatttggcagtttaaattagcacagacgttgaggccttgctgagttattaggctatgtaaaagaggttaaaaatatgatcattctttattgttaattggtaatattttctcatacattaggtaaatgtcaagctttgggtctctggagtataactttttgtaacattagccattatttggtaacagaatttaaggatgatggaatgatggaaggtattacatatttctaaaacttaattaagctctaggtcagataacaatggagtaaagtgatacctgcatttttttccccagtgtaatcttaatttactattgtatttttcacttaaaattttgtagggaaaaaaagttttcaagggaacactaagattaaattgactaggttcaaatatgcttccttatgagattcaaaatttactgtgtgaaattaaagtttaagagacctaaaaaaatgtactcccataaagaatcaatactgcttc

SEQ ID NO: 357741 - DNA, 2237 bp, Homo sapiens
ataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcagggcttctcaaatttaataactatggaatcttatcagaaagtccattaacatctcaaagaacaacgtggttattgtatcaatcaccatcctttataccaggatttgcatatccttcaagatgcctgaagacaatcggaggggtatacaagcaagcgaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaacagttaaactatgaaccaagttttatggggtttaagtcatgtttttagaattgcaaattaaattatttgttcaccattcctattgctatcttttatagataacattcttgggatcttttatagcattcttgggcacaagggattaaatacaacttttatatacagaggatctttacatgtttattaaatctgaatttgaagatacattccaatcttgcataaagtgtttgttgggcttttacattacgtaattaaaaaacaaaattttttaaccaattttatgtgccatgtcacgtttaatgctatcttgtgtgaccagatcccaccagtaatgacaaaactgtcttaaacctcatttttttttttttttgagacaagagtttcactcttgttgcccaaacgagagcaatggcaccatctcgactcactgcaacctctgcctcccaggttcaagcaattctcctgcctcagcctcccaagtagctgggattacacgcatgcgccaccatgcctggctacttttgtatttttaatagagacagggtttcttcatgttggtcaagctggtcatgaactcccaacctcaagtgatccgcccacctcggcctcccaaagtgctgggattacaggcatgagccaccgtgcccagcccttaaatctcatttttaagaaaccctcacctattctgtagtcagctaagcttttaattacattaattttaagcacttgagaataaaatgactgcatttatcatccaagtgtcaaacaattaaaaacctaaaaagggtaactatatataagctgaggtaatatgggcttgataaagcccatgaggtaaatatgaacactaaacttggttttaattctaacagactatatctaaacctgtaagcagtatactcctaacagtaccctcataaattctgaatataattcttgtttgctgcagtcaatatttggcagtttaaattagcacagacgttgaggccttgctgagttattaggctatgtaaaagaggttaaaaatatgatcattctttattgttaattggtaatattttctcatacattaggtaaatgtcaagctttgggtctctggagtataactttttgtaacattagccattatttggtaacagaatttaaggatgatggaatgatggaaggtattacatatttctaaaacttaattaagctctaggtcagataacaatggagtaaagtgatacctgcatttttttccccagtgtaatcttaatttactattgtatttttcacttaaaattttgtagggaaaaaaagttttcaagggaacactaagattaaattgactaggttcaaatatgcttccttatgagattcaaaatttactgtgtgaaattaaagtttaagagacctaaaaaaatgtactcccataaagaatcaatactgcttc

SEQ ID NO: 357742 - DNA, 2676 bp, Homo sapiens
ataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagagaagggatctcaatgtgttgcctaggctggtctcaaacccctgggctcaaacaaacaatccaacccctttggcatcccaaagtgctgggataacaggtaagagctaccatgccctactcaatatgaaacttcagtgaaagaaataatggaatttactatgttaaataaggtctgaaagtggagaaagagaaacctgaagcaacagtaagaaaagccgaaggtttaaaccttcagtcatttgaatatttacgttaaatatcatattttgctatatttttttgcactatgtatatatatattctgccaaatcttattttaagattaaacttctgacacaaaaagttgtgtcttatggtagcatagattcttgggtagaacgctcaaaacttgtcttcctcagaagcaccctactagtaagaaatgcgcttatagaatgacaatgatctttctggttccagagcaaaactcaatttaggtacaagagtttttcagtgacaagagattaattttttagaccttcattctagctgcaaatccaactacaaacaactgggttatctttcttgaattaattcttatttcttgttaaacttagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaacagttaaactatgaaccaagttttatggggtttaagtcatgtttttagaattgcaaattaaattatttgttcaccattcctattgctatcttttatagataacattcttgggatcttttatagcattcttgggcacaagggattaaatacaacttttatatacagaggatctttacatgtttattaaatctgaatttgaagatacattccaatcttgcataaagtgtttgttgggcttttacattacgtaattaaaaaacaaaattttttaaccaattttatgtgccatgtcacgtttaatgctatcttgtgtgaccagatcccaccagtaatgacaaaactgtcttaaacctcatttttttttttttttgagacaagagtttcactcttgttgcccaaacgagagcaatggcaccatctcgactcactgcaacctctgcctcccaggttcaagcaattctcctgcctcagcctcccaagtagctgggattacacgcatgcgccaccatgcctggctacttttgtatttttaatagagacagggtttcttcatgttggtcaagctggtcatgaactcccaacctcaagtgatccgcccacctcggcctcccaaagtgctgggattacaggcatgagccaccgtgcccagcccttaaatctcatttttaagaaaccctcacctattctgtagtcagctaagcttttaattacattaattttaagcacttgagaataaaatgactgcatttatcatccaagtgtcaaacaattaaaaacctaaaaagggtaactatatataagctgaggtaatatgggcttgataaagcccatgaggtaaatatgaacactaaacttggttttaattctaacagactatatctaaacctgtaagcagtatactcctaacagtaccctcataaattctgaatataattcttgtttgctgcagtcaatatttggcagtttaaattagcacagacgttgaggccttgctgagttattaggctatgtaaaagaggttaaaaatatgatcattctttattgttaattggtaatattttctcatacattaggtaaatgtcaagctttgggtctctggagtataactttttgtaacattagccattatttggtaacagaatttaaggatgatggaatgatggaaggtattacatatttctaaaacttaattaagctctaggtcagataacaatggagtaaagtgatacctgcatttttttccccagtgtaatcttaatttactattgtatttttcacttaaaattttgtagggaaaaaaagttttcaagggaacactaagattaaattgactaggttcaaatatgcttccttatgagattcaaaatttactgtgtgaaattaaagtttaagagacctaaaaaaatgtactcccataaagaatcaatactgcttc

SEQ ID NO: 357743 - DNA, 2005 bp, Homo sapiens
ataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaacagttaaactatgaaccaagttttatggggtttaagtcatgtttttagaattgcaaattaaattatttgttcaccattcctattgctatcttttatagataacattcttgggatcttttatagcattcttgggcacaagggattaaatacaacttttatatacagaggatctttacatgtttattaaatctgaatttgaagatacattccaatcttgcataaagtgtttgttgggcttttacattacgtaattaaaaaacaaaattttttaaccaattttatgtgccatgtcacgtttaatgctatcttgtgtgaccagatcccaccagtaatgacaaaactgtcttaaacctcatttttttttttttttgagacaagagtttcactcttgttgcccaaacgagagcaatggcaccatctcgactcactgcaacctctgcctcccaggttcaagcaattctcctgcctcagcctcccaagtagctgggattacacgcatgcgccaccatgcctggctacttttgtatttttaatagagacagggtttcttcatgttggtcaagctggtcatgaactcccaacctcaagtgatccgcccacctcggcctcccaaagtgctgggattacaggcatgagccaccgtgcccagcccttaaatctcatttttaagaaaccctcacctattctgtagtcagctaagcttttaattacattaattttaagcacttgagaataaaatgactgcatttatcatccaagtgtcaaacaattaaaaacctaaaaagggtaactatatataagctgaggtaatatgggcttgataaagcccatgaggtaaatatgaacactaaacttggttttaattctaacagactatatctaaacctgtaagcagtatactcctaacagtaccctcataaattctgaatataattcttgtttgctgcagtcaatatttggcagtttaaattagcacagacgttgaggccttgctgagttattaggctatgtaaaagaggttaaaaatatgatcattctttattgttaattggtaatattttctcatacattaggtaaatgtcaagctttgggtctctggagtataactttttgtaacattagccattatttggtaacagaatttaaggatgatggaatgatggaaggtattacatatttctaaaacttaattaagctctaggtcagataacaatggagtaaagtgatacctgcatttttttccccagtgtaatcttaatttactattgtatttttcacttaaaattttgtagggaaaaaaagttttcaagggaacactaagattaaattgactaggttcaaatatgcttccttatgagattcaaaatttactgtgtgaaattaaagtttaagagacctaaaaaaatgtactcccataaagaatcaatactgcttc

SEQ ID NO: 357744 - DNA, 1122 bp, Homo sapiens
ataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggtaaaattgaaaatggttaatatccagccagtcaacaatacagatgcaaacctaccttctcgacttaatttctgcttccttagtacttacacgccagccaaaatgaactactcttgtttctttgctgttaattactgaaatctgttgtagcagtcaccttttgtgattctgtatctgattctgttacccgtggagatgtgtttccagattcttcccagcaggaagtaatttcctctgagtttagcattttttgtacatcttttatgacaatcagtatgttatatatataatagcgcttatgtttttagcttcactaccatgtctgcacctaaatagaatggtttgtatcagattcgtcttcccgtcattttcaccatgcacatgatattattttggtaaatacttactgaaagtttgaatatatcgggtgtctcttggatgcccaagacacttccagccaagttttagagaccttcaatttatcagaaattcagctgagcgcctgctactcaatctttgttttacgtttcccctgtgaagtctttctgacatgatttttttccccagtgttttattatgaaagtgttcatatatttaaaagctgaaagaaataatttaatgaatattcatgtacccatcatctatatgcagcagttaacattttgccattttttttcattcctccccactttttcattgtcataaaaagttgcagacacttattgttaggcaagacacccttaagatttccagcatgaatttcctaagaattttgaagttctccagcaaaacacaatatcattatttcagctgttttgtaacttttaaaatctaggccaagtgctaattttcctaatttacccaggaatatcttttataccttctccttcccaatcctgcaaaaaaaaaaaa

SEQ ID NO: 357745 - DNA, 1064 bp, Homo sapiens
ataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggtaaaattgaaaatggttaatatccagccagtcaacaatacagatgcaaacctaccttctcgacttaatttctgcttccttagtacttacacgccagccaaaatgaactactcttgtttctttgctgttaattactgaaatctgttgtagcagtcaccttttgtgattctgtatctgattctgttacccgtggagatgtgtttccagattcttcccagcaggaagtaatttcctctgagtttagcattttttgtacatcttttatgacaatcagtatgttatatatataatagcgcttatgtttttagcttcactaccatgtctgcacctaaatagaatggtttgtatcagattcgtcttcccgtcattttcaccatgcacatgatattattttggtaaatacttactgaaagtttgaatatatcgggtgtctcttggatgcccaagacacttccagccaagttttagagaccttcaatttatcagaaattcagctgagcgcctgctactcaatctttgttttacgtttcccctgtgaagtctttctgacatgatttttttccccagtgttttattatgaaagtgttcatatatttaaaagctgaaagaaataatttacattcctccccactttttcattgtcataaaaagttgcagacacttattgttaggcaagacacccttaagatttccagcatgaatttcctaagaattttgaagttctccagcaaaacacaatatcattatttcagctgttttgtaacttttaaaatctaggccaagtgctaattttcctaatttacccaggaatatcttttataccttctccttcccaatcctgcaaaaaaaaaaaa

SEQ ID NO: 357746 - DNA, 1175 bp, Homo sapiens
ataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagagaagggatctcaatgtgttgcctaggctggtctcaaacccctgggctcaaacaaacaatccaacccctttggcatcccaaagtgctgggataacaggtaagagctaccatgccctactcaatatgaaacttcagtgaaagaaataatggaatttactatgttaaataaggtctgaaagtggagaaagagaaacctgaagcaacagtaagaaaagccgaaggtttaaaccttcagtcatttgaatatttacgttaaatatcatattttgctatatttttttgcactatgtatatatatattctgccaaatcttattttaagattaaacttctgacacaaaaagttgtgtcttatggtagcatagattcttgggtagaacgctcaaaacttgtcttcctcagaagcaccctactagtaagaaatgcgcttatagaatgacaatgatctttctggttccagagcaaaactcaatttaggtacaagagtttttcagtgacaagagattaattttttagaccttcattctagctgcaaatccaactacaaacaactgggttatctttcttgaattaattcttatttcttgttaaacttagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaataca

SEQ ID NO: 357747 - DNA, 1016 bp, Homo sapiens
ataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcagggcttctcaaatttaataactatggaatcttatcagaaagtccattaacatctcaaagaacaacgtggttattgtatcaatcaccatcctttataccaggatttgcatatccttcaagatgcctgaagacaatcggaggggtatacaagcaagcgaggttaagaacaatcacttttcagatcctaaacttttatatgtagtgtctgctgataatgcattccctgagaaaatggacctgtggataaaccatcatgcttcatctcatttcctgtctcctctttcaccatttttctttcttttcttttcttttttttttttttttcttgagacaagctcttactctgtcacctaagctagaatgcagtggcgtgatcatatctcactgcaacctaaaactcaggctcaagcagtaccctcacctcagcctcccgagtagctgagactaacaggcacactccatcatgcccgaataatttttgttaattttttgtagagatgaggtcttgctttgttgtctaggctggtcttgaactgggctcaagcgatcctcccactttggccttccaaagtgctgggattccagatgcgagccaccgcaccagtcccccaattatttttctaaggatgtatgaaggaaaggcatctctctagcctggtagaatcttactatgacaaaaatgctccagaaaataaacatctcttaggagctacacacagagacaaggaaacactggtaactcaagaaatgtcttacgggttatcagcgaacctacaagggtattcacctgctcgcagcaataaacacc

SEQ ID NO: 357748 - DNA, 611 bp, Homo sapiens
gccgttgagacaagtaggaatcttaggaaatgttagcctgccagttcctacttttcctaactacctgcctcaccacccccatcaaatggtggtcatgttttttgtcacccaccattcaggggagatgctatcaacgaaccacgctggctacacacaaataccttttcctcagatgatattaatcatctttgccttaaaaactgaagctctaccaagttttcactatgagagaaaaaaaattacaacacctagccttgtagttaacaccacaactgactaatggaagttgacaagatctaaatgcttatacaaactatcccaaggtcacaggaaattaatggcaatattatacaaggttagggtagttcactttctataggaatttggattttacttcttaaactacaatggaaatgtctcaggcagtctgctttgggaatgtattcttgaataatactgatttctcattgaaggaaaaaacactatatccaacaactcagatatggcagaagtgaagtcaatgttccgggaagttcttccaaagcaaggtatgtacatcacaaatattgaggtcattgattattacaggactaaagaagtcataggcagtg

SEQ ID NO: 357749 - DNA, 459 bp, Homo sapiens
ataatggcaaaaggagattcctggcttcctgtttccagggtgacgtagatttttttccttcgccagtctcaccgttacccggggcaacagctgagccgtctgggaagggatgcatctatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaataca

SEQ ID NO: 357750 - DNA, 736 bp, Homo sapiens
ataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcagggcttctcaaatttaataactatggaatcttatcagaaagtccattaacatctcaaagaacaacgtggttattgtatcaatcaccatcctttataccaggatttgcatatccttcaagatgcctgaagacaatcggaggggtatacaagcaagcgaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaataca

SEQ ID NO: 357751 - DNA, 543 bp, Homo sapiens
gagatgaagtctcgctctattgcccaggatggagtgcagtggcgcgatcatggctcaccgcaacctccacctctcaggctcaagcgattctcccgcctcagcctcccgagtagccgccaatctaatgcctgtttttgaaacattctatgcaactagtctattttctattttattgttcagattttaccacatttctaatcaggctgccaaataaatttttagaaaagaaagttataagcccagaaaaaaaaattatatatttttctagaactctgtacaataatccctaaagaaatcttttatgtgcataaaaaaaatctcaaaacaaattctactgaaattacgttgagactatcaataaccattgccaataattatcaatggacattttaagggatagaatagagaaatacaatacattccatggcgtttcaattaattagaacatgacaactgaagcacgcttaattccatccttttaagatgcatgtgtgagaaagatttccatcatcaagggaagcctacttttacatttcccacgtg

SEQ ID NO: 357752 - DNA, 412 bp, Homo sapiens
ctggagtgcagtggtgcagtcttggctcactgcagcctccacctcccaggttcaagtgattctcctgcctcagcctcctgagtagctgggattacaggcacctgactaatttttgtatttttagtagagatggggtttcaccatgttggccaggctggtcttgaactcctgacctcaaatgatctgtcagccttggcctcccaaagtactgggattgcaggcgtaagccatccagccctgtcaaagttgtcttttttttttttatagttggttgtttaaagattccaatgaagtctacacgttgcacttggcttaatgtctgtataagagtctcttttaaggagtgatttttgttatttgttttaaacaaaagtgttaggattttatttttatttttttgtaggttagaacc

SEQ ID NO: 357753 - DNA, 1309 bp, Homo sapiens
atatgtatttttgtcagaaggttagctaggcagaggtcttagacatgagagtgctggaaagaaaagtatagaggacagattggtaggagagggatccagataggtattcatggacccagtcttgaagggcagatatgttatgcaagggagttagctagattctgtagtcatgcaaaaattttaagcatagaagataattgtgtaccatattagaaaggttactctcgcagcattggtttggacgggttggaacagaggtgtgaattgtgttggaaataggtgattttactatagtattttagatgaaagatgaatagtatttgtgggtcagtgagaatgaggaaggaggtgagagaaaaatagaatcaacataatcagtaattgcttagatatgaggggagtaagaatatgaggaatctgtgataattcacaggtttgtaacttgggcaacccagtgtgccatccactgaaatttgtaatactgaaggggaggagtaggtgaaatagacaaagatgagtttattatatgcatcttttaaaaggttcaaaaacaaacacttgggtgttgtaaagtcatcaccctttgtggggcacaaaggaagaggttggctgagaaggggctgtggagtagaaaggtgaagaatagggccttcgtgaacacagacacgtggacaggctgagtaagtagagcctgcaaagaatactgaagatgacagagaggtagaagccaagctaaaggattatggtcataaaattgagagaagtgaatgtttcaagaagggagggtaaatagtgccagttgctgcagtgaagtaacattagaggaaaccttagaagtacttggagtttttcagcatctaggttattgatgatcataggggaggcgtttcaatggagtgatacgttagagcagcttgttacttatctcagtgagaggtgaaggtttggaaatcagcagtctggacattctgagagatggctatgaaagaaaaagacagtggacgagtaagaattcagttgcaagaataaggctcaagatagttttaaatttttaagagggcttactccagttacaggagggaaggaattaagtataggtacaggaaaatgaactaggaagggcagaagcacaggtaggtagttgaagaagttcatcatcatagttcatagttttaatttttttatgaggtggaatcaagcttatgttttgggagaagggactggactaaaattgaggccgaagcgggcagatcacgaggtcaggagatcgagaccatcctggctaatatggtgaaaccccgtctctact

SEQ ID NO: 357754 - DNA, 1048 bp, Homo sapiens
ttgagccagacaacatggttcagggaagaaatggaatagggatgaaagagaagtctgtgagtgaaccatctttagtgagtgaaggaggtgagagaaaaatagaatcaacataatcagtaattgcttagatatgaggggagtaagaatatgaggaatctgtgataattcacaggtttgtaacttgggcaacccagtgtgccatccactgaaatttgtaatactgaaggggaggagtaggtgaaatagacaaagatgagtttattatatgcatcttttaaaaggttcaaaaacaaacacttgggtgttgtaaagtcatcaccctttgtggggcacaaaggaagaggttggctgagaaggggctgtggagtagaaaggtgaagaatagggccttcgtgaacacagacacgtggacaggctgagtaagtagagcctgcaaagaatactgaagatgacagagaggtagaagccaagctaaaggattatggtcataaaattgagagaagtgaatgtttcaagaagggagggtaaatagtgccagttgctgcagtgaagtaacattagaggaaaccttagaagtacttggagtttttcagcatctaggttattgatgatcataggggaggcgtttcaatggagtgatacgttagagcagcttgttacttatctcagtgagaggtgaaggtttggaaatcagcagtctggacattctgagagatggctatgaaagaaaaagacagtggacgagtaagaattcagttgcaagaataaggctcaagatagttttaaatttttaagagggcttactccagttacaggagggaaggaattaagtataggtacaggaaaatgaactaggaagggcagaagcacaggtaggtagttgaagaagttcatcatcatagttcatagttttaatttttttatgaggtggaatcaagcttatgttttgggagaagggactggactaaaattgaggccgaagcgggcagatcacgaggtcaggagatcgagaccatcctggctaatatggtgaaaccccgtctctact

SEQ ID NO: 357755 - DNA, 366 bp, Homo sapiens
aactttaggtatgtccagctatcaaacttaaatttttttctttctctgtagagctgctctggataaggctaccgtgcttctgagtatgtctaaaggtggaaagcgtaaagatagtgtgtggggctctggaggtgggcagcaatctgtcaatcaccttgttaaagaggtaatgattgggtattgtttttaacttaatttatatgtattcctctgagtgaaataaattgtggctactagctggtatttttatggacaaaaattaagttcggtcttacagctgcaattggaaaatgaaataatttttttaatatgtggctttataaccttttattataaattatatgattaaaaaatgagtctgttaaa

SEQ ID NO: 357756 - DNA, 3599 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgta

SEQ ID NO: 357757 - DNA, 4105 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgtatataaaagttgtatttaatcccttgtgcccaagaatgctataaaagatcccaagaatgttatctataaaagatagcaataggaatggtgaacaaataatttaatttgcaattctaaaaacatgacttaaaccccataaaacttggttcatagtttaactgtttatgttcaatacaaaccagagtgtttacattcacaatacaaatttcatcaatcttggatatttttgtatttctatgaatactatcaattttattgataacacatactactttcagcacacagaagcatattttctagttattgttaaatagtagataaggcaggttgttccctaaagtgctcagttatcattcagtgggttatttgccgttgatccttttctgccatttcttgttggcgaattgtattctgtgctgcttgatgcattttctctagtttttccagagtcagagattttaagggtaaaagtttgggtttacacagcaccattgtcattatatcttc

SEQ ID NO: 357758 - DNA, 3552 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggagaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgta

SEQ ID NO: 357759 - DNA, 3726 bp, Homo sapiens
gaacaaaactgtggcccagtggtagctaattcagtagcctttctgacttaaagagctttcagggcaaagccaagtgcctccacttgatctccatggaatttgagtatgaaggacactctgctaggtgatggggatacaaagaaggacatacagtctagttgtggtttctcctttgaagcttatgacttagttggaagaaaaagactgctatataaaaagaaagtgatttccatgacgtgttgaatgaatagtatgtgagcaattagtgttcctgtacctagagttgtaagggaagttttaatgcagggagtaagacttgggctatatcctaaaggattttgataactgaaaataacagtgagggcgacattctactgggaactccagtatgttgatctctttcagaagaatcaattttatataggctggaagatttacaggatgatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgta

SEQ ID NO: 357760 - DNA, 3494 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgta

SEQ ID NO: 357761 - DNA, 2479 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcaacagcaccagacacatggggttttagcagcttaactttaccccctacataaagctttgtaaaacccgtgattg

SEQ ID NO: 357762 - DNA, 4177 bp, Homo sapiens
tttttaggctgaagccagtcacaagttgtaaatatagcagtcccctcttatccgtggtttcactttccgcagtttcagttacccatggtccaatgtggtttgaaaatattgagtggaaactttcagaagtaattcataagttttaaattgcatgccattctgagtagtgtgatgagatctcctgctgtccagcttcatccacctcatcctgcccaggatgtgagccattccgttgtccagcgtgtatccgcaatgtatacactactcgtgcattcgtcacatggtagctgtctaggttatcggattgagaaaacagtatttattgggttcggtactatctgtggtttaaggcatcctcggacggggcttggaacataccccttgtagataagggggcactacatttcagagcttttttagcatggggagagaggaatggtttgatgatggatgttaattttctttttgaaatttcaattgaacagtgcttttttccttagagattttttttctgtcactacaacattgatctttgtgttatactttttattataataatgctaatcgtgaaggctttggttcctgcttcatttttttttaaagtgaaattttaattaaaacaccatttatgataggaagccatcatgaaactttttgattactaaaagattggttttgagagagacataaaaattttgagagaaaaaattaacagaagacatgggggttgggagcaaattatgtatttgctgtggttaatgattctaatctatatattggcttattgtattctgattttgtaaaagagcagtgacatataaattctactatttttattatgatttattattattattttttagctttgttgtccaggctggagtgcagtgatgaattatagctcactgcagcctcgaactcttgggcttaagagatccttctgcctcagcttcctgagtagctaggactacaggggcaagctaccatgtctggctaatttttaaaacttttttgtagagacagggtcttgctatgtttcccaggctagtattgaactccaggcctcaagtgaacctcccgcctttgcctcccaaagtgttgggattataggtatgagtctccttgcctggcctagattctatttttatatgcgatcaatgtatgtagcatgtctttgtcttgtgctaagtggggattattaaccacttagaatataaaattgtacaacaatttcacttgtttatttgcattttgttttttataactcttactccaggtcttttcccctcaaaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgta

SEQ ID NO: 357763 - DNA, 3385 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgta

SEQ ID NO: 357764 - DNA, 2928 bp, Homo sapiens
tgctggtcacgttaaggatcccccagggtcttttcccctcaaaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgta

SEQ ID NO: 357765 - DNA, 2234 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagaggctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctt

SEQ ID NO: 357766 - DNA, 2897 bp, Homo sapiens
  misc_feature (27)..(28): n is a, c, g, or t
cttgaaccgttaccaagtcgcgctcgnnccccttcaaacgcctgcaacacctgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgta

SEQ ID NO: 357767 - DNA, 2631 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttatgtgtggtttctcgcggagggggccagaggagagggcacagaaaagagttacaccctcttctcttatagagcgtggaaaatatctcataatatagagccataccccttggtggataagtgtgccgagtgtgttatattatactctataatctctattctcccaaagttttgtgccattggaaagtgtctctgtgcactgtgcgcactctcgctttctctttctcagaggacacgaggtgtgttttgtgtggatagtaaaaaactcagcgtggggtttatatatcacaagagctctcttaatttagaggggggcgtcaagaggtttaaagcgcgggcgtctaaaaaacccccagtgtgtgtggccgtgacgtgcgcgtgctgtgagagaaataaacgtgtgggccatgtgagggagagtgtcaaaacagagagacacagagttatcatatcccattgttcgtctttataaagagaaacacttttttatcacacaaacacactttgagtctcctagtgagacgaaactctctattctcataatctgtttctccccgaggggggcaacccctatcaccggtgggagtggtgcggcctcttactaaaagatgacactttatcacaacgcggttatagaagtcttatacaacgaggggggggccgtgggcaaccccatttctcataaatttttatctccatcaacaaaaaacaactgtgggaacaacaaagttggaaaaccccgtggggttcttctttagacaaagaaaat

SEQ ID NO: 357768 - DNA, 2031 bp, Homo sapiens
  misc_feature (47)..(47): n is a, c, g, or t
aaaaaaaaaaaaaaaaaaaaaaaaaaaaaaaaaaaagagatctttgnccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgta

SEQ ID NO: 357769 - DNA, 1168 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctaggtaagtaaatcacttttcc

SEQ ID NO: 357770 - DNA, 1989 bp, Homo sapiens
tgcagctcgtgccgaattcggcacgaggagagaactagtctcgagtttttttttttcttcattacaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagcatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgta

SEQ ID NO: 357771 - DNA, 299 bp, Homo sapiens
aaagctaacacgtaacgaaaaaataccaagtttttaatttttttatatattgactatagtcagaatttgtatctgttttcatgtctttttttttcttcattacaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaac

SEQ ID NO: 357772 - DNA, 378 bp, Homo sapiens
tggtaaaaacaaacaaatttggtttgtttttggtaagaaacaaacatgctttgttaaaattcagtgccttggtttactttccttgataatgtgaaaagtaatcttatttagttgtttattagattgaagtagatgaaattcccaatatgtgactgtaatttacctacaaaaatggtaatgtcatgtgattcaacctaatctaacttaccactatatctataaaacagtagatacttaaaatacttagaatttttttcttcatttttctctttaagatcctgataacttaagtgactctctcttttccggtgatgaagaaaatgctgggactgaggaagtaaagaatgaaataaatggaaattggatttcagcatcctc

SEQ ID NO: 357773 - DNA, 399 bp, Homo sapiens
ttctcagtgattcagacacactgaagcattgcatttgaatcataattatgaaccatttaaaaattggggatttattttttaattatgaaaaattctgttgtaatagtaccacatccaatgtatatgttattagctgtttgttacccactatttcattatattggaatgagggcaaataatcctgtaggcaagcacgatattttaaaagttaggaattctgacacatctcaacttttaaatctaatagattgatatgctgctgaaagaatatttactctctggagacatatctgaagctgaacattgccttaaggaactggaagtacctcattttcaccatgagcttgtatatgaagtaagattaccttgccatgtcaaagataattattaagtgttcct

SEQ ID NO: 357774 - DNA, 2342 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctt

SEQ ID NO: 357775 - DNA, 2740 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatattttta

SEQ ID NO: 357776 - DNA, 3557 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgta

SEQ ID NO: 357777 - DNA, 2255 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagccacctgttacttaactgtctagtcttttaagaccgatcagtatgttccctggaaa

SEQ ID NO: 357778 - DNA, 2222 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaacttgtgctaacaactcttacaattcagatatatatttttataacatctaagactgcaagagttcttatattcagtagctctctgg

SEQ ID NO: 357779 - DNA, 2845 bp, Homo sapiens
gactgacctagaggatccccgactagtccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttctttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgta

SEQ ID NO: 357780 - DNA, 1464 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagaggtaatgattgggtattgtttttaacttaatttatatgtattcctctgagtgaaataaattgtggctactagctggtatttttatggacaaaaattaagttcggtcttacagctgcaattggaaaatgaaataatttttttaatatgtggctttataaccttttattataaattatatgattaaaaaatgagtctgttaaa

SEQ ID NO: 357781 - DNA, 1337 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagcactggacgggcagcctttgaaggctgtggcagacagatgccagcagacaagcactctgctggtggtggaggcaggaggagaggagtgaacgtggtgagtctctggaagcacgttgagcagctctcctcttcttggagctcagggtttttcgatgagtggtggggctgaagctagatgggcagctgac

SEQ ID NO: 357782 - DNA, 938 bp, Homo sapiens
ctagtggtggcttacagtttggtctacttttaaatatttgtatataagttatccttacgttttgcagttttgaatttcacactggtatcttcctgccattcaacttgctttagggttgttggtgttgtgttttgaaagattgtgaagtcgaccttctaaaaatgagttcaaagaaaaatcagtaaagtaaatatcctcctgaaattgtaagtttcttggcaagtagaattttttgtattaacttctgttttaggttatctgcaaactcaagaattgagagaactagacagcataagctcagatttaaggaagataccatttttcatagatatggttttagctgtttttgaattgtgagtgttcagtagcaagcttttcaaagtttttgtaattgtggaaataatgtatgagaaatatttagacagcatctgtttctatttttagactgggctggcttagatgaagatgaagatgcacatgtctgggaggataattgggatgatgacaatgtagaggatgacttctctaatcagttacggtaagttttaagccagatttttattgtagttcagtattaattataagcatggaatatgtaatttacatagatgattaacctcttaaaagctacttaatctttgaaataggtttttgaactgtgtaaagtaagacatattgtcttcatctcctgtgattctaaacatgaacactttgtgtaattgcatacaacttttattctttctggtctttttacaaaggtagtaaaatagaagcatatttgctatttcttatccttaggaatttaattctgtcaatgttaattttctaccaatatcaaataactcagcagaaattagaatcatagagtgctgggacctaatagattggtgattctcaaactggaatggagatagggttccccaggatgtactgtgtca

SEQ ID NO: 357783 - DNA, 822 bp, Homo sapiens
  misc_feature (255)..(255): n is a, c, g, or t
  misc_feature (479)..(479): n is a, c, g, or t
  misc_feature (487)..(487): n is a, c, g, or t
  misc_feature (497)..(497): n is a, c, g, or t
aaactttctagaccattcggttgtgtgcgcggaggctcgatggaggtacaggtgaacactgagtactagtacgcatgatttcctacggagcagtcctggtcatgatctaggtgcattgaatatctcaccaattagaaaacgtcccgggcgggaaacacgatggcgcttgctgatatcaaatgtccagaattggaagtgctgatgtctgttacgtgaattctagtcaataaggaagctccaagtcgaggcatcgantattcataatttacagccccgaagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataagnaaaaaaanaaaaaaaaanaaaaaaaaaagggggggggggggcgttatgaaaatttccccggggggggcgcattttatgagctgacccccggtttgtttttgaaaagaaggggcgcccccaattagaggggcggttattaataaggagaaggagggcggcccgattatacaaacgtcggtgggggggagacactgctgtccggagtgatttgtggagaggcccccctcttctggggggggaacaaattggagcacccccccaaagataatagccgcagggaaaaaaaacgcggggtgattgggacccgcgttttcgcggagagagttgctcggatagtggagtc

SEQ ID NO: 357784 - DNA, 883 bp, Homo sapiens
  misc_feature (530)..(530): n is a, c, g, or t
ttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataacaaaaaaaacaaaaaaaaaaaaaaaaaaaaaaaaaanaaaaaaaaaaaaaaaaaaaaagggggggggggctaaaaaatatcaccggggggggcgcccattgggcacccgtttttttggaaaagaggggggcccacaagagggggcgcagtataatcaagcaagaggacagggccgggttgttaaaacaaccgtggagcggggggaaaaacactgactgtcgtggaggcatctggggaaaagaacccacactcgggggggggggacaattaggtggacaacccccagcgaagatatatagcgccgggggaaaaaaacatgagagggtatgcggggcgagcaccgaggtaattgcggcggagaaattggccaaggaaatatagagaaattag

SEQ ID NO: 357785 - DNA, 707 bp, Homo sapiens
  misc_feature (530)..(530): n is a, c, g, or t
  misc_feature (600)..(601): n is a, c, g, or t
ttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataacaaaaaaaacaaaaaaaaaaaaaaaaaaaaaaaaaanaaaaaaaaaaaaaaaaaaaaaaaaaaaaaaaaaagaaaaaaaaaaaaaaaaaaaaaaaaaaaaaaaaaanncctttgggggcccctttggcccagtggttttttaatttggcaaagtttattcctggggcccaatttggggcttctttggccaattcgcccttatggggggggatta

SEQ ID NO: 357786 - DNA, 1096 bp, Homo sapiens
  misc_feature (743)..(743): n is a, c, g, or t
acgttaaagtctttaatccatcttgaattaatttttgtaaaatgtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatgtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataacaaaaaaaacaaaaaaaaaaaaaaaaaaaaaaaaaanaaaaaaaaaaaaaaaaaaaaagggggggggggctaaaaaatatcaccggggggggcgcccattgggcacccgtttttttggaaaagaggggggcccacaagagggggcgcagtataatcaagcaagaggacagggccgggttgttaaaacaaccgtggagcggggggaaaaacactgactgtcgtggaggcatctggggaaaagaacccacactcgggggggggggacaattaggtggacaacccccagcgaagatatatagcgccgggggaaaaaaacatgagagggtatgcggggcgagcaccgaggtaattgcggcggagaaattggccaaggaaatatagagaaattag

SEQ ID NO: 357787 - DNA, 963 bp, Homo sapiens
ttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataatcttggtttggttcagaagtcttaatcttttgcttctaatcaattttcttgtcatgattttccaaaaccttattatatatagatagtaaaatttcatattatgaaattttcttttttttttttaatgttaactgagtgaggctcaggttaaatgatctggagtagatttcacctgattcccaattcagtacttttcttaaaccacatcaattaattgttacttctattttataaggaatttcttttacatcacattgaaccttaatctcttctgtattttgatagcttaggcaacatttgctgacatttataaggtgacctttcaaaacctgtgttttaaaaatattaatcattttaaattgctgtaatttacttagttcctgagccattaataatattattaatggttgttagcgtattattggtacttaaagtccaaagtagtttaatcacagtaagaatggtgtctt

SEQ ID NO: 357788 - DNA, 884 bp, Homo sapiens
  misc_feature (541)..(541): n is a, c, g, or t
  misc_feature (549)..(549): n is a, c, g, or t
  misc_feature (559)..(559): n is a, c, g, or t
ttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataaaaaaaaaaaaaaagaaaaaaaaaaaaaaaaaaaaaaaaaaaaaaaagnaaaaaaanaaaaaaaaanaaaaaaaaaagggggggggggggcgttatgaaaatttccccggggggggcgcattttatgagctgacccccggtttgtttttgaaaagaaggggcgcccccaattagaggggcggttattaataaggagaaggagggcggcccgattatacaaacgtcggtgggggggagacactgctgtccggagtgatttgtggagaggcccccctcttctggggggggaacaaattggagcacccccccaaagataatagccgcagggaaaaaaaacgcggggtgattgggacccgcgttttcgcggagagagttgctcggatagtggagtc

SEQ ID NO: 357789 - DNA, 791 bp, Homo sapiens
ttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataaaaaaaaaaaaaaagaaaaaaaaaaaaaaaaaaaaaaaaaaaaaaaatttttgggcgggttgggccctggaaaaagtttttaaaaccctcgcggtggggcgccgggggcgcccaggaagggaactagcagcacggggccacagcgggctcccaaagaaaacccggggacgggacaaggggctgggctcctcccacaataaaaaaccccggggggaaccgagacggtctggacaatctcaatgggagctcagaggcaaacgggaatctacacacgagactcaagaacccgatatcaatac

SEQ ID NO: 357790 - DNA, 672 bp, Homo sapiens
ttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataaaaaaaaaaaaaaagaaaaaaaaaaaaaaaaaaaaaaaaaaaaaaaatttctttttattattctttgtcccctctgtttgtttgtcggtattctcaaactatgagtgttttatgtttttctcgcgctggtttggttatatctgtcggcgtcccctttctcccgccggcgctaacatttct

SEQ ID NO: 357791 - DNA, 813 bp, Homo sapiens
ttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataaaaaaataaacccttctcccccatttaaaccatgtcggccgcctcggcccatttgattttagacttgagcaggcttatccctgcgacccgtatttagagctcacttggccaattcggcctatggtgaggtcgtttacaattcactggcccgggtttacaccgtggtgacttggaaaaccctggtgtttcccaactaatccggcttgagacattcccctttccaagttggggtaatacgaaaaggccctcaccgttcgcttttcaaagttggaaacctgatggggaatggaattttaccgttatatttagaaaattcacgta

SEQ ID NO: 357792 - DNA, 786 bp, Homo sapiens
ttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataaaaaaaaaaaaaaaaaaaaccccgaaactagttctctctctctctctttcaccccgggttgaggcactggcgggtatgggggggcataagcttggtccacaaccagctcaatcagcgcactctgacctgggtggaaagctcggggggaccccagggactcactaccacgcaggagcgggaagaagcagatgtacccaggggattcctccaacagcagagggctccaggaacagcacgagccccaccattttacaccaaacggtctgactgggggccaccgtgccgaacagagac

SEQ ID NO: 357793 - DNA, 664 bp, Homo sapiens
ttctctaagccagcccagtcttcggcagggaactcttcaaactcgtcgtcttcctctaacagacctaagtcaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataaaaaaaaaaaaaaagaaaaaaaaaaaaaaaaaaaaaaaaaaaaaaaatttctttttattattctttgtcccctctgtttgtttgtcggtattctcaaactatgagtgttttatgtttttctcgcgctggtttggttatatctgtcggcgtcccctttctcccgccggcgctaacatttct

SEQ ID NO: 357794 - DNA, 1208 bp, Homo sapiens
ctagtggtggcttacagtttggtctacttttaaatatttgtatataagttatccttacgttttgcagttttgaatttcacactggtatcttcctgccattcaacttgctttagggttgttggtgttgtgttttgaaagattgtgaagtcgaccttctaaaaatgagttcaaagaaaaatcagtaaagtaaatatcctcctgaaattgtaagtttcttggcaagtagaattttttgtattaacttctgttttaggttatctgcaaactcaagaattgagagaactagacagcataagctcagatttaaggaagataccatttttcatagatatggttttagctgtttttgaattgtgagtgttcagtagcaagcttttcaaagtttttgtaattgtggaaataatgtatgagaaatatttagacagcatctgtttctatttttagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataatcttggtttggttcagaagtcttaatcttttgcttctaatcaattttcttgtcatgattttccaaaaccttattatatatagatagtaaaatttcatattatgaaattttcttttttttttttaatgttaactgagtgaggctcaggttaaatgatctggagtagatttcacctgattcccaattcagtacttttcttaaaccacatcaattaattgttacttctattttataaggaatttcttttacatcacattgaaccttaatctcttctgtattttgatagcttaggcaacatttgctgacatttataaggtgacctttcaaaacctgtgttttaaaaatattaatcattttaaattgctgtaatttacttagttcctgagccattaataatattattaatggttgttagcgtattattggtacttaaagtccaaagtagtttaatcacagtaagaatggtgtctt

SEQ ID NO: 357795 - DNA, 1107 bp, Homo sapiens
actcttgaggacaaggaccttctctggacacagatatgcctcagagtaactgttgcatagcattcagacactgctggttgaattgtccatttacttggcatgcaacacatggcaaagtaaagggggaaggagattttctgctgcatgtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataatcttggtttggttcagaagtcttaatcttttgcttctaatcaattttcttgtcatgattttccaaaaccttattatatatagatagtaaaatttcatattatgaaattttcttttttttttttaatgttaactgagtgaggctcaggttaaatgatctggagtagatttcacctgattcccaattcagtacttttcttaaaccacatcaattaattgttacttctattttataaggaatttcttttacatcacattgaaccttaatctcttctgtattttgatagcttaggcaacatttgctgacatttataaggtgacctttcaaaacctgtgttttaaaaatattaatcattttaaattgctgtaatttacttagttcctgagccattaataatattattaatggttgttagcgtattattggtacttaaagtccaaagtagtttaatcacagtaagaatggtgtctt

SEQ ID NO: 357796 - DNA, 692 bp, Homo sapiens
acgttaaagtctttaatccatcttgaattaatttttgtaaaatgtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatgtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaactttgaacccctttggggcccctttttttttttttaaaaaaaaaatttttttaaaaccccccaaaaaatttttttttttttctagggcagagaacccaggatgggacactaaa

SEQ ID NO: 357797 - DNA, 861 bp, Homo sapiens
gatcattatctgagagaagaatccaggcgccacggtgtaacagctgcctcagccatgattgtaagtttcctgaggcctccccagccacacagaaccgactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataatcttggtttggttcagaagtcttaatcttttgcttctaatcaattttcttgtcatgattttccaaaaccttattatatatagatagtaaaatttcatattatgaaattttcttttttttttttaatgttaactgagtgaggctcaggttaaatgatctggagtagatttcacctgattcccaattcagtacttttcttaaaccacatcaattaattgttacttctattttataaggaatttcttttacatcacattgaaccttaatctcttctgtattttgatagcttaggcaacatttgctgacatttataaggtgacctttcaaaacctgtgttttaaaaatattaatcattttaaattgctgtaatttacttagttcctgagccattaataatattattaatggttgttagcgtattattggtacttaaagtccaaagtagtttaatcacagtaagaatggtgtctt

SEQ ID NO: 357798 - DNA, 816 bp, Homo sapiens
gatcattatctgagagaagaatccaggcgccacggtgtaacagctgcctcagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataatcttggtttggttcagaagtcttaatcttttgcttctaatcaattttcttgtcatgattttccaaaaccttattatatatagatagtaaaatttcatattatgaaattttcttttttttttttaatgttaactgagtgaggctcaggttaaatgatctggagtagatttcacctgattcccaattcagtacttttcttaaaccacatcaattaattgttacttctattttataaggaatttcttttacatcacattgaaccttaatctcttctgtattttgatagcttaggcaacatttgctgacatttataaggtgacctttcaaaacctgtgttttaaaaatattaatcattttaaattgctgtaatttacttagttcctgagccattaataatattattaatggttgttagcgtattattggtacttaaagtccaaagtagtttaatcacagtaagaatggtgtctt

SEQ ID NO: 357799 - DNA, 1202 bp, Homo sapiens
acgttaaagtctttaatccatcttgaattaatttttgtaaaatgtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatgtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacggtgatgttctttctgttttatcttagagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataatcttggtttggttcagaagtcttaatcttttgcttctaatcaattttcttgtcatgattttccaaaaccttattatatatagatagtaaaatttcatattatgaaattttcttttttttttttaatgttaactgagtgaggctcaggttaaatgatctggagtagatttcacctgattcccaattcagtacttttcttaaaccacatcaattaattgttacttctattttataaggaatttcttttacatcacattgaaccttaatctcttctgtattttgatagcttaggcaacatttgctgacatttataaggtgacctttcaaaacctgtgttttaaaaatattaatcattttaaattgctgtaatttacttagttcctgagccattaataatattattaatggttgttagcgtattattggtacttaaagtccaaagtagtttaatcacagtaagaatggtgtctt

SEQ ID NO: 357800 - DNA, 830 bp, Homo sapiens
acgttaaagtctttaatccatcttgaattaatttttgtaaaatgtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatgtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacggatcccaaaatgggtaggctctgtttgaccttgtggaattgttgaagatgcagttctcaacagcatcactagatgttgactccaacatttgtgctgtgtttgctgtacaaggaggaaaagtgggaagaaagcatggcataaaaagggggaggagacccagcataagaagcccagctcagcgggccagaggaccctggatccatgagagtaagcatccggcctttgcaaagcaacagataaacttggagatgcccaactccagagcgacaacagagttagcctgggtctgcaggtaagcagatgacagccacaggaggaaaaaaa

SEQ ID NO: 357801 - DNA, 377 bp, Homo sapiens
  misc_feature (330)..(330): n is a, c, g, or t
tcagctcggtaccctctggatgcaagtgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggacactntgcatccagaggacactttgcatccagaggacactttgcatccagag

SEQ ID NO: 357802 - DNA, 836 bp, Homo sapiens
  misc_feature (24)..(24): n is a, c, g, or t
ctagaggatccctgaacattcgtncaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataatcttggtttggttcagaagtcttaatcttttgcttctaatcaattttcttgtcatgattttccaaaaccttattatatatagatagtaaaatttcatattatgaaattttcttttttttttttaatgttaactgagtgaggctcaggttaaatgatctggagtagatttcacctgattcccaattcagtacttttcttaaaccacatcaattaattgttacttctattttataaggaatttcttttacatcacattgaaccttaatctcttctgtattttgatagcttaggcaacatttgctgacatttataaggtgacctttcaaaacctgtgttttaaaaatattaatcattttaaattgctgtaatttacttagttcctgagccattaataatattattaatggttgttagcgtattattggtacttaaagtccaaagtagtttaatcacagtaagaatggtgtctt

SEQ ID NO: 357803 - DNA, 945 bp, Homo sapiens
tcagctcggtaccctctggatgcaagtgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaaagggcaactgtactcctgatgatattggtctgtgaaaccccgtatggctgctatgttctccaccaaaagggaagaatgtgcagtgctttcctctgctgttaacagatcatcaacctgtatgtgttcatggccccacctaaatgtaaagagctgggatgcacaggattggagagctattattgagcactagtcatgtggatatgtgcatggagtcagtaaggagggagtggggtggtgctacagcatttcaggcaaagagagcagcctgggtgaaggtccagcctgggcaaggtaggattatggttagcatactgcagtattgttgggtagtaagagattatgatacttcctgtagctacataacaggggcttacttgaagggtgaccctatttattgtttcagtcaccagtgttcagtggaaagtcatgtctttcatataaaaaggaggtcaggcacagtggctcatgcctgtaatcccagcactttgggagggcaaggcaggtggatcacctgaggtcaggagttcgagaccagcctggccaacatggtgaaacctgtctctactaaaaatataaaaattagccaggcatggtggtgcatgcctgtaatcccagctacttgggaggctgaggcaggacaattgcttgaacccgggaggtggaggttgccgtgagccgagattgcaccactgcatcccagcctgggtgacagagcaagactctgtctcaaaaagaatgaataaaaata

SEQ ID NO: 357804 - DNA, 126 bp, Homo sapiens
gctgcatagagaaagaactctggagacatgcagagaatccctaccttgtattcagaatatccaacccaaagatttacctcactactgattagtacttccatgggaggacactccctatggctgagg

SEQ ID NO: 357805 - DNA, 589 bp, Homo sapiens
gcccaggcgggtctgcactgctgctgctgggaggaagggaaagtctgtcttctgtggcatcagcagtgcagagcccgcctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 357806 - DNA, 669 bp, Homo sapiens
cgcgtggtacccacctcaccccgttgggcctcttcctcaagttctgtacctctctggtctcttccagttttaatctttaaaaagaagaagaagcagcaatgcataagctgagtgattccccgcggaatccaaagctaacagagccaataaggcaccttcgagggcatcccagcccagctactgagccaccagcacagtggtccagaggacgaccttgtgcctagacccaccgggagtcagagccactgcgcatcccggaggcatctctctcaaccgttcgagcttggggcggtggcctcaccccttgagcctcaatttctgcgtccgcagaaggaaccaccacccgagctcacagttaacaatgtcagcgaagcgccgagccggtggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggtaaaagacccttgtggcca

SEQ ID NO: 357807 - DNA, 4331 bp, Homo sapiens
ccagacggccccacaaccctgcgcgtcgcctcagagggggcgcgcttgactgacaggcggcggcggcgcagttgcgagcgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatccttcgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggatgatgacctgaaacctcgaggcctcacgggcatgaagaacctcgggaactcctgctacatgaacgccgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagtcatctctgagaaggagcggatgaaggaccgcaagttctcctggggccagcagcgtacaaactcggagcaagtggacgaggacgctgatgtggacactgccatggctgcccttgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagcctcgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccgcctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 357808 - DNA, 4419 bp, Homo sapiens
ccagacggccccacaaccctgcgcgtcgcctcagagggggcgcgcttgactgacaggcggcggcggcgcagttgcgagcgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatccttcgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggatgatgacctgaaacctcgaggcctcacgggcatgaagaacctcgggaactcctgctacatgaacgccgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagtcatctctgagaaggagcggatgaaggaccgcaagttctcctggggccagcagcgtacaaactcggagcaagtggacgaggacgctgatgtggacactgccatggctgcccttgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagcctcgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctagcaggtccctgaaagcaccttcctggaggatgtgggagggccctggacatggcccggccccactgctgagtgcccgtgtccccacagccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccgcctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 357809 - DNA, 4508 bp, Homo sapiens
ccagacggccccacaaccctgcgcgtcgcctcagagggggcgcgcttgactgacaggcggcggcggcgcagttgcgagcgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatccttcgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggatgatgacctgaaacctcgaggcctcacgggcatgaagaacctcgggaactcctgctacatgaacgccgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagtcatctctgagaaggagcggatgaaggaccgcaagttctcctggggccagcagcgtacaaactcggagcaagtggacgaggacgctgatgtggacactgccatggctgcccttgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagcctcgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctgtaagtcgccccggctggtccctccatggcactctgggtcctctcctcactctccagagaccctcacatgtccttttgaacatccaaagagcaggtccctgaaagcaccttcctggaggatgtgggagggccctggacatggcccggccccactgctgagtgcccgtgtccccacagccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccgcctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 357810 - DNA, 3653 bp, Homo sapiens
ccagacggccccacaaccctgcgcgtcgcctcagagggggcgcgcttgactgacaggcggcggcggcgcagttgcgagcgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatccttcgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggatgatgacctgaaacctcgaggcctcacgggcatgaagaacctcgggaactcctgctacatgaacgccgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagtcatctctgagaaggagcggatgaaggaccgcaagttctcctggggccagcagcgtacaaactcggagcaagtggacgaggacgctgatgtggacactgccatggctgcccttgaccagcccgcggaggcccagcccccgtcaccacggtcctccagcccctgccggacgccagtccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccgcctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 357811 - DNA, 2819 bp, Homo sapiens
tgaccccagggagggggtagcatgatcatggccgcaacacagatgaaggaggccaggcttgcggagagatgatgtcactcggcccaggacacggacgtgtctggctccaggcctctgccccgacccgccgtgcccggctgcttctctgggccttcagggtccttctgcggctcaggcctgacagacctcagccagagtcccttcagctcctgttcttgcccaggccctggcagcacccctgcactccttttctgtctgtaggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccgcctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 357812 - DNA, 3974 bp, Homo sapiens
ccagacggccccacaaccctgcgcgtcgcctcagagggggcgcgcttgactgacaggcggcggcggcgcagttgcgagcgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatccttcgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggatgatgacctgaaacctcgaggcctcacgggcatgaagaacctcgggaactcctgctacatgaacgccgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagtcatctctgagaaggagcggatgaaggaccgcaagttctcctggggccagcagcgtacaaactcggagcaagtggacgaggacgctgatgtggacactgccatggctgcccttgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagcctcgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccgcctggagggatgtgggggctgtgcagggtgcagcgctcaggtggatcctgggaagcagcctctggatgctgagtggagggagccactgagcacagcaaggcaccaaagcccctggagaaaccgccagggcgaggaaaaaggggttccgatccaga

SEQ ID NO: 357813 - DNA, 2850 bp, Homo sapiens
ccagacggccccacaaccctgcgcgtcgcctcagagggggcgcgcttgactgacaggcggcggcggcgcagttgcgagcgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatccttcgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggatgatgacctgaaacctcgaggcctcacgggcatgaagaacctcgggaactcctgctacatgaacgccgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagtcatctctgagaaggagcggatgaaggaccgcaagttctcctggggccagcagcgtacaaactcggagcaagtggacgaggacgctgatgtggacactgccatggctgcccttgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagcctcgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgagcagcataaggtattccgcgagcagcaggagaattccaaagcggt

SEQ ID NO: 357814 - DNA, 365 bp, Homo sapiens
ccaccatgcccagccaggttttatttcttaagcagaaatcattatagtcacttttttttgctccctcattttgcatccttgctaacctctgaccctttgttttactgccctaggtgacaacatgtacagctgtgagcggtgtaagaagtaagtgagccttcccccgccttctccctaactgccgtttctgtgccctacatattccccttgggttcctgcagagagccccctataatcctgccttcccagaagggagccgggtggagggctgcttccctggcccctggccctgatgccggacactgatgctggctcgtgcttcctccccaggctgcggaacggagtgaagtactgcaaagtcctgc

SEQ ID NO: 357815 - DNA, 4429 bp, Homo sapiens
ccagacggccccacaaccctgcgcgtcgcctcagagggggcgcgcttgactgacaggcggcggcggcgcagttgcgagcgcaggtgagttccgggccgccaccggctgcttctgtgggccgggcctctgagcattggcgacccccgcccggctccgggctgacagggcctggcttcgccaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatccttcgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggatgatgacctgaaacctcgaggcctcacgggcatgaagaacctcgggaactcctgctacatgaacgccgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagtcatctctgagaaggagcggatgaaggaccgcaagttctcctggggccagcagcgtacaaactcggagcaagtggacgaggacgctgatgtggacactgccatggctgcccttgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagcctcgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccgcctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 357816 - DNA, 5037 bp, Homo sapiens
ccagacggccccacaaccctgcgcgtcgcctcagagggggcgcgcttgactgacaggcggcggcggcgcagttgcgagcgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatccttcgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggatgatgacctgaaacctcgaggcctcacgggcatgaagaacctcgggaactcctgctacatgaacgccgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagtcatctctgagaaggagcggatgaaggaccgcaagttctcctggggccagcagcgtacaaactcggagcaagtggacgaggacgctgatgtggacactgccatggctgcccttgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagcctcgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccgcctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgttaaaaaaaaaaaaaaaaaaaaaaaaaaaaaaaaaaaaaaaaaaaaaaaaaaaaaaaaaaaaagggggggcgcgcgcgcccccagaaattttcccccggggggcgcccacacacattatgccgccgccaccaccgcgtttttgtgtgtatcaacaaaggggggtgccccactaaatatagtggaggggctgttttttatataaaacgtagggcagcgagggcggcccgcgcggtttatatacacaaagcggcggtagaggaagcgggaaacacacagcgcagtgtaaacatgggagggaacaatctctttgtgagaagaagagagacggccctccatatcaatatgttggggggggggggcgagagagaacaccaatagtggtgtgtcgcgaaaaaaacatctcctactcttagcgcgagagatatatatttcagggagactctcttactggaggcgggacatactaattcacagataactttctaacaggagggtactctatacgtggggggtgtgtgccacacaaacgcgacgggcgcgtcatgtatgtgtgcgccgagtgccggtggcgtgggtgagaggacacaatttgtgtgggtgcgctccatagcgcgtgagggtcttgttatgcttgtgattgatcagagagaaatctttttttttatatcacacgcggggggggacacttgccggtgtcgttctaaacc

SEQ ID NO: 357817 - DNA, 2073 bp, Homo sapiens
aggatagggtggagaggttagtggagtgcaattatttgtaatctcgtttgtcagaatgatcagtagagtgtgtacatatctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccgcctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 357818 - DNA, 1811 bp, Homo sapiens
catctcgtgtgtcctggaaattccctctgctgggtcctcagactgccacagaggagcattgggtggctcaggcgcctcatccattagagacttcacgctgacccccaggcctggggcggccccacttgggatggctctgctgctgtggagggtggagggcatggcaggggctgaacccgagcccgctgtgtctgttgcagagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccgcctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 357819 - DNA, 2118 bp, Homo sapiens
ccagacggccccacaaccctgcgcgtcgcctcagagggggcgcgcttgactgacaggcggcggcggcgcagttgcgagcgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatccttcgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggatgatgacctgaaacctcgaggcctcacgggcatgaagaacctcgggaactcctgctacatgaacgccgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagtcatctctgagaaggagcggatgaaggaccgcaagttctcctggggccagcagcgtacaaactcggagcaagtggacgaggacgctgatgtggacactgccatggctgcccttgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagcctcgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtgcgcccaccttgccactactgggcgacatgggctgggcctgtcctggttttcctgggcgggagacagtacacagtgaagtccatgcatttggggaaccagggaggtcctgggaggagctgggggccgaagcctgcagaggagttggcttaatatgcaggggatttcttggctactttgaagtggccaggattggatagtcccttggagctggagggcgatggacagcagggaggtgaccacatggcaggttgaagggagggcagcagcaggacacaggcctggttggcgggaagggcagcagctttcccagggctgcctctcctgcctgaggccagagacccg

SEQ ID NO: 357820 - DNA, 4400 bp, Homo sapiens
atataaaatagtattccaaataagtacattttatagcaaaattatgcatttttcctaagactttcatcaccaatatcgccttataccctgcttttgttgggtctcaccatggagcggaaagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggagga

SEQ ID NO: 357821 - DNA, 4939 bp, Homo sapiens
  misc_feature (324)..(324): n is a, c, g, or t
agcgcgcggcatcgtggggcgggggtggggcgggactgagggcggagtgtgagcgggctcggttttgggccgcggcgggagcgggagtcgccgccactcgagtgcgcaggcgcctggcgattaccggtctcaccatggagcggaaaggtgagcggtggagcggcctccgccacgaggggcaatggtcgccggggcgaggcccgggtcagcgccgggagcttcgcttaactgccgcggttcggttcccggacgtgcggcgcccctccactgaggtggcgccgccccacaccccctgcctctgggctgcgggtccgcgcccctcantccgggcgtcctctggcgccggccgtagccgccccttgttccccgccaggccggctcgcgccttggggccactccagggcccggcccttggcgggcgacgcagacccccacccgcccgccccctgacccggcctgagacccctccggcgcatcccgcccgggcgctgctctgcgccccgtgggccgccagccccacgccggccgcctcgccgagcccgcagccgcccccgaggcaggccccgcagccgggcctggcgcccctgctgggtctccaccctcaccttggtcgcctcctttcctccacattcgcccttcatccatccctctctcctgcagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggagga

SEQ ID NO: 357822 - DNA, 4454 bp, Homo sapiens
agcgcgcggcatcgtggggcgggggtggggcgggactgagggcggagtgtgagcgggctcggttttgggccgcggcgggagcgggagtcgccgccactcgagtgcgcaggcgcctggcgattaccggtctcaccatggagcggaaagtgcttgcgctccaggcccgaaagaaaaggaccaaggccaagaaggacaaagcccaaaggaagaatgggcatttttgtatcatttcttagatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggagga

SEQ ID NO: 357823 - DNA, 3433 bp, Homo sapiens
tttagatgtttagtcatgtttttatgtcactcagtataagttctagaaaatgttttaatcttgtgagaaatgtttctgttctttcactcacacacatatgcatatatctttttttgttcgtttgttccttagaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggagga

SEQ ID NO: 357824 - DNA, 3382 bp, Homo sapiens
tttagatgtttagtcatgtttttatgtcactcagtataagttctagaaaatgttttaatcttgtgagaaatgtttctgttctttcactcacacacatatgcatatatctttttttgttcgtttgttccttagaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggagga

SEQ ID NO: 357825 - DNA, 4372 bp, Homo sapiens
agcgcgcggcatcgtggggcgggggtggggcgggactgagggcggagtgtgagcgggctcggttttgggccgcggcgggagcgggagtcgccgccactcgagtgcgcaggcgcctggcgattaccggtctcaccatggagcggaaagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacattcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggagga

SEQ ID NO: 357826 - DNA, 2389 bp, Homo sapiens
ggagttaagccaagggtgccggagacactcggcggcagtggctctcttctcagggatcagctccaacatgggcagtaagaaatctgtgaagccagctgcctcttcctgcgaccactcatacttctccactagaacctcaaaaaggccccaaggtttcagcttcgtgatatgtttcaggtcaccttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggagga

SEQ ID NO: 357827 - DNA, 1090 bp, Homo sapiens
acgcgtccggtaagtaatactgaaggaatatgtaatattctaggtcaagtctaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggagga

SEQ ID NO: 357828 - DNA, 2109 bp, Homo sapiens
agcgcgcggcatcgtggggcgggggtggggcgggactgagggcggagtgtgagcgggctcggttttgggccgcggcgggagcgggagtcgccgccactcgagtgcgcaggcgcctggcgattaccggtctcaccatggagcggaaagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaagtcttattgatgatgcctgttgtctgtaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggtaatgttttttccccttggctttcacttgttaagtggtacatatcttgccctgtttgctaatttcagtaaaccagcaaattaactagcagaaaagaacgtaacacagatgatttaccataggtattctaaattctatgtctagagaggtccgaattcaaaaacctgtctggcatttcatttggttactgctaagttcctgttaggtgaaggaaccaaaagtttcttactacagattgttagtggggggaaataatgaaaacaactactaagaggtgttgttggttttgattaggagattacaagtatctttgcatttttagcactc

SEQ ID NO: 357829 - DNA, 358 bp, Homo sapiens
aaaacaaattaccttaaatttttggagccgtatgaagaatagaggcacttctttctgaggcatatgtcagaaaagaaatgctttgtgaatgaaggattagattctgattgcaaaatttgattcctcatagactacatgggttagtttgtgggtttccacaagagtaccttgtcatttgtctgtgttgatcagtggctttttctgtactgtcttcactgcaggtgacctgaaacatatcacgaagctgaaaccttggggcctttttgaggttctagtggagaagtatgagtggtcgcaggaagaggcagctggcttcacagatttcttactgcccatgttggagctgatccctgagaag

SEQ ID NO: 357830 - DNA, 279 bp, Homo sapiens
aagtttggcaatttctattcattattttctttaaaaatggtaataatatagcttctacttaagtcatttaaaaacaatagttttctctgcaatgtagactacataagaaagacttttcattctggtagagtgttttatctgagccttagtttatattgcctgatgaatgccagaattcttacttggttttcttttcttttcagtcagtactgctccccagcctaaaccagtaagtataaggtgtttttatatttaattttgatctatggactatgggca

SEQ ID NO: 357831 - DNA, 459 bp, Homo sapiens
aatgatctataagttttcccaagggaacaagagttacttcatattgagccaaatagcaatcagctttccaaaggccttcttttcttttgtgctttcatatactgtcctcttttttttttaggcctttgaactggccacaggtgactatttgtttgaacctcattcaggggaagagtacactcgagatgaaggtgagtccccttaaccatggatgtgtgtgcgtggtatttacactttccacattaagctaacatcatttgttagtaccgaagagccttagtcttgttagtgtgcaaaacatgtaaatcccagaaaagttagaaatataaaagacattttatattaggtttttagatattttctgaaagatactaaagagctctgtcagagtcaaaaggccacagttcacctaaaacttctgtgtgctggacaattttttcttcaacatctagttatctt

SEQ ID NO: 357832 - DNA, 4426 bp, Homo sapiens
agcgcgcggcatcgtggggcgggggtggggcgggactgagggcggagtgtgagcgggctcggttttgggccgcggcgggagcgggagtcgccgccactcgagtgcgcaggcgcctggcgattaccggtctcaccatggagcggaaagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggagga

SEQ ID NO: 357833 - DNA, 4372 bp, Homo sapiens
agcgcgcggcatcgtggggcgggggtggggcgggactgagggcggagtgtgagcgggctcggttttgggccgcggcgggagcgggagtcgccgccactcgagtgcgcaggcgcctggcgattaccggtctcaccatggagcggaaagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtcccatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggagga

SEQ ID NO: 357834 - DNA, 4376 bp, Homo sapiens
  misc_feature (4364)..(4365): n is a, c, g, or t
agcgcgcggcatcgtggggcgggggtggggcgggactgagggcggagtgtgagcgggctcggttttgggccgcggcgggagcgggagtcgccgccactcgagtgcgcaggcgcctggcgattaccggtctcaccatggagcggaaagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgttgttctctcgacgaggggatcctactanntgtcggcctgc

SEQ ID NO: 357835 - DNA, 2991 bp, Homo sapiens
ctctctctctctctctctctctctctctctctctctctctctctctctctctcctcgtgccgaattcggcacgagcattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggagga

SEQ ID NO: 357836 - DNA, 2222 bp, Homo sapiens
agcgcgcggcatcgtggggcgggggtggggcgggactgagggcggagtgtgagcgggctcggttttgggccgcggcgggagcgggagtcgccgccactcgagtgcgcaggcgcctggcgattaccggtctcaccatggagcggaaagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggactgaaacatatcacgaagctgaaaccttgcggacataaaagagcgacaaagagggagaaagtaagagaggacgcaaggcagaaggcaggagggctcaacagaatcataaagcccatggtggaagatgatccagaagaagaagaaccacgcgcacgagggaatacggaacctggagtgaactcataaagccgagaagagcacagcgaaatcaaaagcgaaccgcgacgacctaagcatactcacccagtaggagagaaacctaagaacaaacgagaaagacaagaaagggggacgaccgaaaca

SEQ ID NO: 357837 - DNA, 2978 bp, Homo sapiens
ttggcgctctacctcgccgcccctgagccttcccgtccgcctcgccacgcgcccggacggcctggggttgctgcccgtcagtctcgaaaggtgtttttggggaaaaaaatcacaatctggacgtgagaaaggacatgaggagactaaagacctgggattttgtcaatcagaatgaaaccaatgttgaaagacttttcaaatctattgttggtggtactctgtgactatgttcttggagaagctgaatatcttctcttgagagagccaggccatgtagcactaagcaacgacacagtgtatgtggatttccagtattttgatggtgctaatgggacactgaggaatgtatctgtcctgctgttggaggccaacaccaatcagactgtaactaccaagtacctcctgaccaaccagtcccagggaacactaaagtttgagtgcttctatttcaaggaggctggtgactactggttcacaatgactccagaagcaacagacaacagcactccattcccctggtgggagaaaagtgcctttctgaaggtggaatggcctgtctttcacgttgacttgaataggagtgccaaggcagcagaaggcaccttccaagtgggcctatttaccagtcaaccactgtgcccgtttcctgtggacaagcccaacattgtagtggatgtcatcttcaccaacagtcttcctgaggcaagaagaaattcaagacagccgctggaaataagaaccagcaaaaggacagaacttgctcaaggtcagtgggttgagtttggctgtgcacccttggggccagaagcctatgtcaccgtggtgctgaagctgcttgggcgagactcagtcattacctccacaggacccattgacctggcccagaaatttggatacaaactggtgatggtgccagaactcacatgtgagtccggggtagaggtgacagtgctgcctccaccatgcaccttcgtccaaggagtggtcactgtcttcaaggaggcccccagataccctgggaagaggaccattcacttggctgaaaacagcctgcccctgggagagaggaggacaatttttaactgtactttgtttgacatggggaagaataagtactgctttgactttggcatttcaagcagaagccatttttctgcaaaggaggagtgcatgctaattcagagaaatacagaaacttggggactgtggcagccatggagccagtgtagtgccacatgtggggatggtgtcagagagcgtcgccgagtgtgtctcacttccttcccctccagtcctgtctgccctggaatgtccttggaggcctccctgtgttccctggaggagtgtgctgctttccagccatccagcccatctcctcttcagccccagggtccagtgaagtccaacaacatcgtgactgtcactggtatatccttgtgcttgttcatcatcattgccactgtgctcatcacgctgtggaggaggttcggccggccagccaagtgcagcacacctgctcgacacaactccatccactcccccagcttccggaagaactcggacgaggagaatatctgcgagctgagcgagcagcgcgggagcttctcggatgggggagacgggcccacggggagtccaggggacacaggcatccctctgacctacaggcggagcgggccggtacctcccgaggatgatgcctctggcagcgagagcttccagtccaacgcccagaagataatcccacctctgttcagctaccgccttgcccagcagcagttaaaggagatgaaaaagaaaggtctgacggaaactaccaaagtgtatcacgtgtctcagagtcccctgacagacactgccattgatgcggcccccagcgctcccttagatttggaaagcccggaagaagctgcagcaaacaagttccggatcaaatccccatttccggagcagcccgcggtcagtgccggggaaaggcctccctccaggctggatctaaatgtgactcaggccagttgtgccataagccccagccagactctgatccgcaagtcacaggcaaggcacgtgggcagcagagggggcccgtccgaaaggagccatgccaggaacgcccatttcaggaggacagcgagtttccatgaagccaggcaggcccggccgttccgagagaggagcatgtccactctgactccacggcaggcccctgcctacagctctaggacgcggacctgcgagcaggcagaggacagatttaggcctcagagtcgaggtgcccacctgtttcctgaaaaactggagcatttccaagaggcaagtggaacccgtggtccattaaaccctctccctaaatcctacactttggggcagcccttgaggaaaccagaccttggggatcaccaggcaggattagtggccggaattgagagaacagagccccacagagctcgtcggggaccgtcccccagtcacaagagtgtctcaaggaagcagtcttctcccatatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagctttacacagctggggtctgctactcgcgttttgtagacttttgtgtaactatttgtaccgtaggacagaatgtgaggaggaagtaacacacagaggaggatgtgtgtgtatgcatgtgtttgaattcacaaggaagaaattatttatcttgagctttttcctttgttattcaatttctattgatttattagtaataacaatgataataaaatgtaaatgagcaaatggg

SEQ ID NO: 357838 - DNA, 3101 bp, Homo sapiens
agatttagtgaatgcgtgcaagatgctggaagcactgaaattacctctcaggctccgtgtgtttgacagtggcgtcatggtaattgagcttcagtctcacaaggaagaggaaatggtggcctcggccctggagacagtttcagaaaagggatccctaacatcagaagagtttgctaagcttgtgggaatgtctgtcctcctagccaaagaaaggtgtttttggggaaaaaaatcacaatctggacgtgagaaaggacatgaggagactaaagacctgggattttgtcaatcagaatgaaaccaatgttgaaagacttttcaaatctattgttggtggtactctgtgactatgttcttggagaagctgaatatcttctcttgagagagccaggccatgtagcactaagcaacgacacagtgtatgtggatttccagtattttgatggtgctaatgggacactgaggaatgtatctgtcctgctgttggaggccaacaccaatcagactgtaactaccaagtacctcctgaccaaccagtcccagggaacactaaagtttgagtgcttctatttcaaggaggctggtgactactggttcacaatgactccagaagcaacagacaacagcactccattcccctggtgggagaaaagtgcctttctgaaggtggaatggcctgtctttcacgttgacttgaataggagtgccaaggcagcagaaggcaccttccaagtgggcctatttaccagtcaaccactgtgcccgtttcctgtggacaagcccaacattgtagtggatgtcatcttcaccaacagtcttcctgaggcaagaagaaattcaagacagccgctggaaataagaaccagcaaaaggacagaacttgctcaaggtcagtgggttgagtttggctgtgcacccttggggccagaagcctatgtcaccgtggtgctgaagctgcttgggcgagactcagtcattacctccacaggacccattgacctggcccagaaatttggatacaaactggtgatggtgccagaactcacatgtgagtccggggtagaggtgacagtgctgcctccaccatgcaccttcgtccaaggagtggtcactgtcttcaaggaggcccccagataccctgggaagaggaccattcacttggctgaaaacagcctgcccctgggagagaggaggacaatttttaactgtactttgtttgacatggggaagaataagtactgctttgactttggcatttcaagcagaagccatttttctgcaaaggaggagtgcatgctaattcagagaaatacagaaacttggggactgtggcagccatggagccagtgtagtgccacatgtggggatggtgtcagagagcgtcgccgagtgtgtctcacttccttcccctccagtcctgtctgccctggaatgtccttggaggcctccctgtgttccctggaggagtgtgctgctttccagccatccagcccatctcctcttcagccccagggtccagtgaagtccaacaacatcgtgactgtcactggtatatccttgtgcttgttcatcatcattgccactgtgctcatcacgctgtggaggaggttcggccggccagccaagtgcagcacacctgctcgacacaactccatccactcccccagcttccggaagaactcggacgaggagaatatctgcgagctgagcgagcagcgcgggagcttctcggatgggggagacgggcccacggggagtccaggggacacaggcatccctctgacctacaggcggagcgggccggtacctcccgaggatgatgcctctggcagcgagagcttccagtccaacgcccagaagataatcccacctctgttcagctaccgccttgcccagcagcagttaaaggagatgaaaaagaaaggtctgacggaaactaccaaagtgtatcacgtgtctcagagtcccctgacagacactgccattgatgcggcccccagcgctcccttagatttggaaagcccggaagaagctgcagcaaacaagttccggatcaaatccccatttccggagcagcccgcggtcagtgccggggaaaggcctccctccaggctggatctaaatgtgactcaggccagttgtgccataagccccagccagactctgatccgcaagtcacaggcaaggcacgtgggcagcagagggggcccgtccgaaaggagccatgccaggaacgcccatttcaggaggacagcgagtttccatgaagccaggcaggcccggccgttccgagagaggagcatgtccactctgactccacggcaggcccctgcctacagctctaggacgcggacctgcgagcaggcagaggacagatttaggcctcagagtcgaggtgcccacctgtttcctgaaaaactggagcatttccaagaggcaagtggaacccgtggtccattaaaccctctccctaaatcctacactttggggcagcccttgaggaaaccagaccttggggatcaccaggcaggattagtggccggaattgagagaacagagccccacagagctcgtcggggaccgtcccccagtcacaagagtgtctcaaggaagcagtcttctcccatatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagctttacacagctggggtctgctactcgcgttttgtagacttttgtgtaactatttgtaccgtaggacagaatgtgaggaggaagtaacacacagaggaggatgtgtgtgtatgcatgtgtttgaattcacaaggaagaaattatttatcttgagctttttcctttgttattcaatttctattgatttattagtaataacaatgataataaaatgtaaatgagcaaatggg

SEQ ID NO: 357839 - DNA, 2984 bp, Homo sapiens
  misc_feature (2922)..(2922): n is a, c, g, or t
  misc_feature (2926)..(2926): n is a, c, g, or t
  misc_feature (2929)..(2929): n is a, c, g, or t
  misc_feature (2970)..(2973): n is a, c, g, or t
ttggcgctctacctcgccgcccctgagccttcccgtccgcctcgccacgcgcccggacggcctggggttgctgcccgtcagtctcgaaaggtgtttttggggaaaaaaatcacaatctggacgtgagaaaggacatgaggagactaaagacctgggattttgtcaatcagaatgaaaccaatgttgaaagacttttcaaatctattgttggtggtactctgtgactatgttcttggagaagctgaatatcttctcttgagagagccaggccatgtagcactaagcaacgacacagtgtatgtggatttccagtattttgatggtgctaatgggacactgaggaatgtatctgtcctgctgttggaggccaacaccaatcagactgtaactaccaagtacctcctgaccaaccagtcccagggaacactaaagtttgagtgcttctatttcaaggaggctggtgactactggttcacaatgactccagaagcaacagacaacagcactccattcccctggtgggagaaaagtgcctttctgaaggtggaatggcctgtctttcacgttgacttgaataggagtgccaaggcagcagaaggcaccttccaagtgggcctatttaccagtcaaccactgtgcccgtttcctgtggacaagcccaacattgtagtggatgtcatcttcaccaacagtcttcctgaggcaagaagaaattcaagacagccgctggaaataagaaccagcaaaaggacagaacttgctcaaggtcagtgggttgagtttggctgtgcacccttggggccagaagcctatgtcaccgtggtgctgaagctgcttgggcgagactcagtcattacctccacaggacccattgacctggcccagaaatttggatacaaactggtgatggtgccagaactcacatgtgagtccggggtagaggtgacagtgctgcctccaccatgcaccttcgtccaaggagtggtcactgtcttcaaggaggcccccagataccctgggaagaggaccattcacttggctgaaaacagcctgcccctgggagagaggaggacaatttttaactgtactttgtttgacatggggaagaataagtactgctttgactttggcatttcaagcagaagccatttttctgcaaaggaggagtgcatgctaattcagagaaatacagaaacttggggactgtggcagccatggagccagtgtagtgccacatgtggggatggtgtcagagagcgtcgccgagtgtgtctcacttccttcccctccagtcctgtctgccctggaatgtccttggaggcctccctgtgttccctggaggagtgtgctgctttccagccatccagcccatctcctcttcagccccagggtccagtgaagtccaacaacatcgtgactgtcactggtatatccttgtgcttgttcatcatcattgccactgtgctcatcacgctgtggaggaggttcggccggccagccaagtgcagcacacctgctcgacacaactccatccactcccccagcttccggaagaactcggacgaggagaatatctgcgagctgagcgagcagcgcgggagcttctcggatgggggagacgggcccacggggagtccaggggacacaggcatccctctgacctacaggcggagcgggccggtacctcccgaggatgatgcctctggcagcgagagcttccagtccaacgcccagaagataatcccacctctgttcagctaccgccttgcccagcagcagttaaaggagatgaaaaagaaaggtctgacggaaactaccaaagtgtatcacgtgtctcagagtcccctgacagacactgccattgatgcggcccccagcgctcccttagatttggaaagcccggaagaagctgcagcaaacaagttccggatcaaatccccatttccggagcagcccgcggtcagtgccggggaaaggcctccctccaggctggatctaaatgtgactcaggccagttgtgccataagccccagccagactctgatccgcaagtcacaggcaaggcacgtgggcagcagagggggcccgtccgaaaggagccatgccaggaacgcccatttcaggaggacagcgagtttccatgaagccaggcaggcccggccgttccgagagaggagcatgtccactctgactccacggcaggcccctgcctacagctctaggacgcggacctgcgagcaggcagaggacagatttaggcctcagagtcgaggtgcccacctgtttcctgaaaaactggagcatttccaagaggcaagtggaacccgtggtccattaaaccctctccctaaatcctacactttggggcagcccttgaggaaaccagaccttggggatcaccaggcaggattagtggccggaattgagagaacagagccccacagagctcgtcggggaccgtcccccagtcacaagagtgtctcaaggaagcagtcttctcccatatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagctttacacagctggggtctgctactcgcgttttgtagacttttgtgtaactatttgtaccgtaggacagaatgtgaggaggaagtaacacacagaggaggatgtgtgtgtatgcatgtgtttgaattcacaaggaagaaattatttatctgacttactccttggtatcattttnttanttnagtttaacttcctggggaacatatgtataaattgatagaannnntctttctctcc

SEQ ID NO: 357840 - DNA, 1717 bp, Homo sapiens
ttggcgctctacctcgccgcccctgagccttcccgtccgcctcgccacgcgcccggacggcctggggttgctgcccgtcagtctcgaaagctttccagccatccagcccatctcctcttcagccccagggtccagtgaagtccaacaacatcgtgactgtcactggtatatccttgtgcttgttcatcatcattgccactgtgctcatcacgctgtggaggaggttcggccggccagccaagtgcagcacacctgctcgacacaactccatccactcccccagcttccggaagaactcggacgaggagaatatctgcgagctgagcgagcagcgcgggagcttctcggatgggggagacgggcccacggggagtccaggggacacaggcatccctctgacctacaggcggagcgggccggtacctcccgaggatgatgcctctggcagcgagagcttccagtccaacgcccagaagataatcccacctctgttcagctaccgccttgcccagcagcagttaaaggagatgaaaaagaaaggtctgacggaaactaccaaagtgtatcacgtgtctcagagtcccctgacagacactgccattgatgcggcccccagcgctcccttagatttggaaagcccggaagaagctgcagcaaacaagttccggatcaaatccccatttccggagcagcccgcggtcagtgccggggaaaggcctccctccaggctggatctaaatgtgactcaggccagttgtgccataagccccagccagactctgatccgcaagtcacaggcaaggcacgtgggcagcagagggggcccgtccgaaaggagccatgccaggaacgcccatttcaggaggacagcgagtttccatgaagccaggcaggcccggccgttccgagagaggagcatgtccactctgactccacggcaggcccctgcctacagctctaggacgcggacctgcgagcaggcagaggacagatttaggcctcagagtcgaggtgcccacctgtttcctgaaaaactggagcatttccaagaggcaagtggaacccgtggtccattaaaccctctccctaaatcctacactttggggcagcccttgaggaaaccagaccttggggatcaccaggcaggattagtggccggaattgagagaacagagccccacagagctcgtcggggaccgtcccccagtcacaagagtgtctcaaggaagcagtcttctcccatatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagctttacacagctggggtctgctactcgcgttttgtagacttttgtgtaactatttgtaccgtaggacagaatgtgaggaggaagtaacacacagaggaggatgtgtgtgtatgcatgtgtttgaattcacaaggaagaaattatttatcttgagctttttcctttgttattcaatttctattgatttattagtaataacaatgataataaaatgtaaatgagcaaatggg

SEQ ID NO: 357841 - DNA, 820 bp, Homo sapiens
gccccgcggggctgtgggagccgaacgccgcggggtcagggcgtgcagtctgggacgcgggatgcttggcgctctacctcgccgcccctgagccttcccgtccgcctcgccacgcgcccggacggcctggggttgctgcccgtcagtctcgaaaggtaagaagcgccctccgcatcctggtgttcgcgcccgtgccgcgagactcttggaggctcctctggggtcgggaaatgcctccggactctgccacctcaccgcagcctgaaggcgcaggtggacggtggcggcccctccccacacccgcctcggccccaggggacgcttttaaggggtattggtctccacacttcggagtcccgaatttaagtgaacctggctctgccttggctcagatgttgccgagtgactgagactggccacagaaccttgaaaaatcgcgtcttgagctactgtttctttccaaaaagaaatcctttctgatatacaaaaagtatgaaatacaaggattaaattaaattaaagacggtcctcattaaggagggctttaagctgacgacgcgaggggtagacttccaggcgtgaactgggcttgcgggcatttgggaagctgagtagatggggcgagccagggcgtcccaggaacgctgcacccaacctgtgggaccagggcagagcaaactcgaatgaacagataaatgaagcctgtttacacgagctgctttagaactagagatttcctcccaataaatactattggtatatatacacacaagcatgtgcatgttggtcagaagggacaaaataactgcttcgttttcca

SEQ ID NO: 357842 - DNA, 1110 bp, Homo sapiens
  misc_feature (689)..(689): n is a, c, g, or t
cgcagcgccttttacggcgccgtaaagcagctcggccgagcagactgctgcggttcctgggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctcaaaaaaaaaacaaacanaaaacacaacaaaaacaccctacaaaaaaccccccggggcacacaaaaaggggggcagaaaaaagaactaacacagcacacgtggaacaacagtatttcggacggccctttttttggaacacccggggaaataccgggggctcccaaaaggagggggaaaaaaatcgcaggaaccccggttcttatatcactaatacgagcacaactacacagtttcatttacaggcaggtcagaagacaagcaatcgaaaacatcgatacggcaacgcaagcttatcagtaactcacttcacatatcatcctctacatcagacccatagttaatcacacctaataacgttctactagtcagtcgtcataactaaaaacacatcaatcatcaactgtccactaaatagctatcgacgcacttcactgtcat

SEQ ID NO: 357843 - DNA, 487 bp, Homo sapiens
cgcagcgccttttacggcgccgtaaagcagctcggccgagcagactgctgcggttcctgggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctctgtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctc

SEQ ID NO: 357844 - DNA, 1167 bp, Homo sapiens
ccaccctccaccccctttactctggctttccgcagggggccggcaggaaagttcccgagggtcgtctgtgctggagcgcagggcggggcaggagcgactgcccatatcccctcgtggtgcctcatctttgtcacctccctgccctagatctgacgcccctccccccatacactagttttctagttactcctgtaggtggcggagcgggcaggaaggcgctttcgcaattgaaccgtctgcatgcccgagggttgggtggtttcggcctcctcttctgttccccctcgtgtctctcctcccaccttgtccccactcccgctagcccgctgcctgccgagggtataagactcccccctcccttgatttatctggttacgtgtaatcgaggcgtgttttacgcgcatctctttgcaagtgggaagtcggcactggagcacacaacagtggcatgggtcgagggtgtcccagggcccctcgcggttctccctcctttcctcccggcctgctccccttcccattgcccctgacacctgcacttcctggtctccccgcagggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctc

SEQ ID NO: 357845 - DNA, 820 bp, Homo sapiens
cgcagcgccttttacggcgccgtaaagcagctcggccgagcagactgctgcggttcctggtgagaccctacccacccccctgcccgcgccgggcctcgtccgctccccggccccttccccgcgggcgtgtgggtcccgggctggggtctcggcgtccgcgatcccgagcccgctcgcttcggcccccctcaggaggctgcgaggaggggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctc

SEQ ID NO: 357846 - DNA, 974 bp, Homo sapiens
ccaccctccaccccctttactctggctttccgcagggggccggcaggaaagttcccgagggtcgtctgtgctggagcgcagggcggggcaggagcgactgcccatatcccctcgtggtgcctcatctttgtcacctccctgccctagatctgacgcccctccccccatacactagttttctagttactcctgtaggtggcggagcgggcaggaaggcgctttcgcaattgaaccgtctgcatgcccgagggttgggtggtttcggcctcctcttctgttccccctcgtgtctctcctcccaccttgtccccactcccgctagcccgctgcctgccgagggtataagactcccccctcccttgatttatctggttacgtgtaatcgaggcgtgttttacgcgcatctctttgcaagtgggaagtcggcactggagcacacaacagtggcatgggtcgagggtgtcccagggcccctcgcggttctccctcctttcctcccggcctgctccccttcccattgcccctgacacctgcacttcctggtctccccgcagggtggcggcggcatggaggcgcgcttcacgcgcgggaagtcggcgctgctggagcgcgcgctggcgcggccgcgcaccgagtcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctc

SEQ ID NO: 357847 - DNA, 672 bp, Homo sapiens
cgcagcgccttttacggcgccgtaaagcagctcggccgagcagactgctgcggttcctgggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctc

SEQ ID NO: 357848 - DNA, 843 bp, Homo sapiens
cgcagcgccttttacggcgccgtaaagcagctcggccgagcagactgctgcggttcctggtgagaccctacccacccccctgcccgcgccgggcctcgtccgctccccggccccttccccgcgggcgtgtgggtcccgggctggggtctcggcgtccgcgatcccgagcccgctcgcttcggcccccctcaggaggctgcgaggagggtgggtttctccccagtgtagagggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctc

SEQ ID NO: 357849 - DNA, 493 bp, Homo sapiens
gcggccgcgccagcgcgcgctccatttgcgccgacttcccgcgcgtgaagcgcgcctccatgccgccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctc

SEQ ID NO: 357850 - DNA, 1052 bp, Homo sapiens
ccaccctccaccccctttactctggctttccgcagggggccggcaggaaagttcccgagggtcgtctgtgctggagcgcagggcggggcaggagcgactgcccatatcccctcgtggtgcctcatctttgtcacctccctgccctagatctgacgcccctccccccatacactagttttctagttactcctgtaggtggcggagcgggcaggaaggcgctttcgcaattgaaccgtctgcatgcccgagggttgggtggtttcggcctcctcttctgttccccctcgtgtctctcctcccaccttgtccccactcccgctagcccgctgcctgccgagggtataagactcccccctcccttgatttatctggttacgtgtaatcgaggcgtgttttacgcgcatctctttgcaagtgggaagtcggcactggagcacacaacagtggcatgggtcgagggtgtcccagggcccctcgcggttctccctcctttcctcccggcctgctccccttcccattgcccctgacacctgcacttcctggtctccccgcagggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctc

SEQ ID NO: 357851 - DNA, 805 bp, Homo sapiens
tgacgtcagcgccgccgcggtgatttaacagcttttgttttgggcagaagaacctatgggcacaaaaagcaggaacgagtagcggtggctgaagaacgagcaggagcttgaatttcagttttcttatgaggaattttccagaaaagatatcttcactgtgaaataactaaataaatgcccactcagtacagtcactgtctcccttttggaacttgatggcaccttaagcccaggtttgcctccactctagaaactcatcagagtgatgcccttctcaaatgggggaggtcccaaagcggatatcctggcagtgtgaaaggccggctaaaggtttgtgccaagaggatctgtggaatgcatctcctacagctggtgctgctgagtaaccactctgatctggcatcttctttgatcaagttacagagcagagtttccagggctggggattgaagtcctgcctcctccctttgtctctggttgtcctcggtaatgtttttccctcaaggtactcatgatacttcccatgggctttccctgcactccaaacacagagctgagacttccacctaatgtagaaagctagcacgagccggcgctgacagatggaagacttgagatgttacaagattatatatggaaacacaaaaggagataccggagccatgacagactgtgatggggctggtggacagttcagcaagacattgatattgtccattggcgctcagttcatctgtaatgacacattcaaggatgacgattaatgtccaatatgtataaagtggatccctttgtaaaaacaata

SEQ ID NO: 357852 - DNA, 788 bp, Homo sapiens
  misc_feature (15)..(15): n is a, c, g, or t
  misc_feature (47)..(47): n is a, c, g, or t
  misc_feature (52)..(52): n is a, c, g, or t
  misc_feature (57)..(57): n is a, c, g, or t
ttaggttaaattaancccctaccttggccaattgcctattatccatnatttntaatnattggtacctgaatttctgttgaacttgctattgtcaggttttggtgtattatgttggttttggagaataaatttaaaagtttcctttatgttatctatacattgcctgaaaagagtttaaatagcattgaaaatgatctcttctttgaagatttaaccaatttcacctgtaaatctgtctgtgctttgtaattttggtgatactgttgactcaaattccaaaagcagtaaatgcagtgttttatatttttctattaaaaatgtaaaatcaaattatattactcatttgtatatagtctttgatttttttctaaagaatgagcccttattttatcataagctcagtgaagaagttgctacagttgtacttttttatttcccacctaatacactactctcagataatgtaccacatgacacacctatctgtgaatatcagaatctgaagttatatatcatgtgtaggccaatctcttaagctctgaatttatttgttcagctactcgatatattcacttagctattccataagctattccataagcacttcaaattcaatatatttagttcattatctgctcccctcttgctattgccaagtttaaaatagtaatttcctccctttcccttgcttcccacatccaatcaattaccatgcccctttacctcagttttctaaataactttaaaatctacccatctctctccattttcccagccactaccttagt

SEQ ID NO: 357853 - DNA, 518 bp, Homo sapiens
tgacgtcagcgccgccgcggtgatttaacagcttttgttttgggcagaagaacctatgggcacaaaaagcaggaacgagtagcggtggctgaagaacgagcaggagcttgaatttcagttttcttatgaggaattttccagaaaagatatcttcactgtgaaataactaaataaatgcccactcagtacactttccctgcactccaaacacagagctgagacttccacctaatgtagaaagctagcacgagccggcgctgacagatggaagacttgagatgttacaagattatatatggaaacacaaaaggtctcactctgtcactccagcctggatgacagagcaacaccctgtcttaaaaaagatcaacattatgaattttatggttatgtataatttaccacaattaaaaaatagtagcagccagatgtggtggcttacaccttggcctccgaaagagttgggattataggcatgagccaacatgcatggtcaaatgctttttaaactagtaatt

SEQ ID NO: 357854 - DNA, 607 bp, Homo sapiens
tgacgtcagcgccgccgcggtgatttaacagcttttgttttgggcagaagaacctatgggcacaaaaagcaggaacgagtagcggtggctgaagaacgagcaggagcttgaatttcagttttcttatgaggaattttccagaaaagatatcttcactgtgaaataactaaataaatgcccactcagtacagtcactgtctcccttttggaacttgatggcaccttaagcccaggtttgcctccactctagaaactcatcagagtgatgcccttctcaaatgggggaggtcccaaagcggatatcctggcagtgtgaaaggccggctaaagctttccctgcactccaaacacagagctgagacttccacctaatgtagaaagctagcacgagccggcgctgacagatggaagacttgagatgttacaagattatatatggaaacacaaaaggagataccggagccatgacagactgtgatggggctggtggacagttcagcaagacattgatattgtccattggcgctcagttcatctgtaatgacacattcaaggatgacgattaatgtccaatatgtataaagtggatccctttgtaaaaacaata

SEQ ID NO: 357855 - DNA, 542 bp, Homo sapiens
tgacgtcagcgccgccgcggtgatttaacagcttttgttttgggcagaagaacctatgggcacaaaaagcaggaacgagtagcggtggctgaagaacgagcaggagcttgaatttcagttttcttatgaggaattttccagaaaagatatcttcactgtgaaataactaaataaatgcccactcagtacaacaaaaatacctgctacatgcttccttctgtatgaatacatgagacctaccttcattcatgtttcctctatgaagctttccctgcactccaaacacagagctgagacttccacctaatgtagaaagctagcacgagccggcgctgacagatggaagacttgagatgttacaagattatatatggaaacacaaaaggagataccggagccatgacagactgtgatggggctggtggacagttcagcaagacattgatattgtccattggcgctcagttcatctgtaatgacacattcaaggatgacgattaatgtccaatatgtataaagtggatccctttgtaaaaacaata

SEQ ID NO: 357856 - DNA, 2954 bp, Homo sapiens
agtttttgccaatctaaaaggtgaaaatattttatcttgcatgaataaagttgaatattttttctttttttcccttaatcgtttgcatttcttctactgggttgtctttttaactgatgcataagagctttttaaattttctcttttttaagagttaggatcttgctgtgtggcttaactctcaaactcttgggctctagcagtcctcccaccttagcctcccgagtagctgggactacaggcatgtgctgctgtgtgcagcagatgtgtacaaaagagctttaaaggtagtactgaaaacagttcctttatagttctatgttgaaaataatttcttcccacttttttattgtcttaatttacagattttttgctgtgcagtaggttttatgttgtcaaatgtattaatcttttaacctaggttttaagttaaaatgctttccccatgctaagatttttaaaaagaaaaactcttccatgtttcctaatatttatactgtttcaaatttttatgttcaaatctttgatccatctgaaattcactttggtgtaaggaataaggaagcattctaaatagatgtcatacacatcaacaaatatatatatatagcccccacccaaatgtggatgtaaactgtttctacatcattattgaataatccatcctctcacccactgatctgaaatctcactgttgctatatactatggtcctatgtggattagcatctacgcctggattctctattcgctcctctgactattcctggcccagtaacttgtctgacaagttcagttttacagtatgttttgttctctagtaaagcagcacacccttgctctcccaactcttccttttcagttttcttggctattcttgagggtttttttccagataaacttcaataaacgtgtatcaaggtccaaaatgaacgctggtaggtttttttttttttcgagttggggtctcactctgtcgcctaggctggagtgcagtggcgtggatctctgctcactgcaagctccgcctcccgggttcatgccattctcctgactcagcctccggagtagcggggactacaggcgcacgccaccaggcccggctaatttttttttttgtatttttagtagagacggggtttcaccgcgttagccagaatggtttctatctcctgacctcatgatccgcccacctcggcctcccaaagtgctgggattacaggcgtgagccactgtgcctggccaaacgctggtaggttttgagtgagaccacattacatttaaatatatttacaatgttttctgctctattctttagtagacttttcctcacgtggtcctacgcatttctttctaagtttattttcatatagcctatccctgtctacaatttaaattgggatcttctatattctagttattatttgtaaataagaaaactactgacttttttctagtatattttctcagaataggattttctatttttctataaaatgaccaatgttatgaagcttcgtaagttttgtcaaagtgatacacacatacagcaaaaaatcaaatagtacagaagtataaaagcaacaacctctgccttgccccttctccaccttcaggtccccttcccagatacaataatttttagctttttatttttaattattctggttgttacctacataactctgggcaatatggaaaagttattgattttgtatattaatttcataatcagttaccttgatgaattctcttgtttctagtagtttttctttagggttttaaagggatacaatcataccatttgcagttagtaaccattttatctcctcttatttccaacttcgtactgttttctcttgtctaatttgtttttaattggtgggtacttctagaacaaggttaaataaaagtggtgttggtgggcgtccttatttctgatattaatgggaatgagtataatgtataaatatataaccatgattttggtttttttccaagtttttatcagtaatgattgctgagttttatcaaaatttttttggcatccattgagaggattatatattactctttgacacattaatgtggttaattaaagtaaccaacttattaaccttgaaatagtcttagttaaataaaccctacttgtcaatgctatatcattattttaatattgtactgaacattttacaaaggtgtttcaccataaggcatattgatctgtaatttttttttttctgttgaacttgctattgtcaggttttggtgtattatgttggttttggagaataaatttaaaagtttcctttatgttatctatacattgcctgaaaagagtttaaatagcattgaaaatgatctcttctttgaagatttaaccaatttcacctgtaaatctgtctgtgctttgtaattttggtgatactgttgactcaaattccaaaagcagtaaatgcagtgttttatatttttctattaaaaatgtaaaatcaaattatattactcatttgtatatagtctttgatttttttctaaagaatgagcccttattttatcataagctcagtgaagaagttgctacagttgtacttttttatttcccacctaatacactactctcagataatgtaccacatgacacacctatctgtgaatatcagaatctgaagttatatatcatgtgtaggccaatctcttaagctctgaatttatttgttcagctactcgatatattcacttagctattccataagctattccataagcacttcaaattcaatatatttagttcattatctgctcccctcttgctattgccaagtttaaaatagtaatttcctccctttcccttgcttcccacatccaatcaattaccatgcccctttacctcagttttctaaataactttaaaatctacccatctctctccattttcccagccactaccttagt

SEQ ID NO: 357857 - DNA, 2527 bp, Homo sapiens
tgacgtcagcgccgccgcggtgatttaacagcttttgttttgggcagaagaacctatgggcacaaaaagcaggaacgagtagcggtggctgaagaacgagcaggagcttgaatttcagttttcttatgaggaattttccagaaaagatatcttcactgtgaaataactaaataaatgcccactcagtacagtcactgtctcccttttggaacttgatggcaccttaagcccaggtttgcctccactctagaaactcatcagagtgatgcccttctcaaatgggggaggtcccaaagcggatatcctggcagtgtgaaaggccggctaaaggtttgtgccaagaggatctgtggaatgcatctcctacagctggtgctgctgagtaaccactctgatctggcatcttctttgatcaagttacagagcagagtttccagggctggggattgaagtcctgcctcctccctttgtctctggttgtcctcgctttccctgcactccaaacacagagctgagacttccacctaatgtagaaagctagcacgagccggcgctgacagatggaagacttgagatgttacaagattatatatggaaacacaaaaggagtggagttgctgggtcatatggcaattcatttgaggaactgagaagcttattccatggaggctgaactgttttatattcccaccagcaacgttagagacggggtttcaccgcgttagccagaatggtttctatctcctgacctcatgatccgcccacctcggcctcccaaagtgctgggattacaggcgtgagccactgtgcctggccaaacgctggtaggttttgagtgagaccacattacatttaaatatatttacaatgttttctgctctattctttagtagacttttcctcacgtggtcctacgcatttctttctaagtttattttcatatagcctatccctgtctacaatttaaattgggatcttctatattctagttattatttgtaaataagaaaactactgacttttttctagtatattttctcagaataggattttctatttttctataaaatgaccaatgttatgaagcttcgtaagttttgtcaaagtgatacacacatacagcaaaaaatcaaatagtacagaagtataaaagcaacaacctctgccttgccccttctccaccttcaggtccccttcccagatacaataatttttagctttttatttttaattattctggttgttacctacataactctgggcaatatggaaaagttattgattttgtatattaatttcataatcagttaccttgatgaattctcttgtttctagtagtttttctttagggttttaaagggatacaatcataccatttgcagttagtaaccattttatctcctcttatttccaacttcgtactgttttctcttgtctaatttgtttttaattggtgggtacttctagaacaaggttaaataaaagtggtgttggtgggcgtccttatttctgatattaatgggaatgagtataatgtataaatatataaccatgattttggtttttttccaagtttttatcagtaatgattgctgagttttatcaaaatttttttggcatccattgagaggattatatattactctttgacacattaatgtggttaattaaagtaaccaacttattaaccttgaaatagtcttagttaaataaaccctacttgtcaatgctatatcattattttaatattgtactgaacattttacaaaggtgtttcaccataaggcatattgatctgtaatttttttttttctgttgaacttgctattgtcaggttttggtgtattatgttggttttggagaataaatttaaaagtttcctttatgttatctatacattgcctgaaaagagtttaaatagcattgaaaatgatctcttctttgaagatttaaccaatttcacctgtaaatctgtctgtgctttgtaattttggtgatactgttgactcaaattccaaaagcagtaaatgcagtgttttatatttttctattaaaaatgtaaaatcaaattatattactcatttgtatatagtctttgatttttttctaaagaatgagcccttattttatcataagctcagtgaagaagttgctacagttgtacttttttatttcccacctaatacactactctcagataatgtaccacatgacacacctatctgtgaatatcagaatctgaagttatatatcatgtgtaggccaatctcttaagctctgaatttatttgttcagctactcgatatattcacttagctattccataagctattccataagcacttcaaattcaatatatttagttcattatctgctcccctcttgctattgccaagtttaaaatagtaatttcctccctttcccttgcttcccacatccaatcaattaccatgcccctttacctcagttttctaaataactttaaaatctacccatctctctccattttcccagccactaccttagt

SEQ ID NO: 357858 - DNA, 1780 bp, Homo sapiens
gggtgcagtggctcacgcctgtaatctcagcactttgggaggccgaggcgtgagccactgtgcctggccaaacgctggtaggttttgagtgagaccacattacatttaaatatatttacaatgttttctgctctattctttagtagacttttcctcacgtggtcctacgcatttctttctaagtttattttcatatagcctatccctgtctacaatttaaattgggatcttctatattctagttattatttgtaaataagaaaactactgacttttttctagtatattttctcagaataggattttctatttttctataaaatgaccaatgttatgaagcttcgtaagttttgtcaaagtgatacacacatacagcaaaaaatcaaatagtacagaagtataaaagcaacaacctctgccttgccccttctccaccttcaggtccccttcccagatacaataatttttagctttttatttttaattattctggttgttacctacataactctgggcaatatggaaaagttattgattttgtatattaatttcataatcagttaccttgatgaattctcttgtttctagtagtttttctttagggttttaaagggatacaatcataccatttgcagttagtaaccattttatctcctcttatttccaacttcgtactgttttctcttgtctaatttgtttttaattggtgggtacttctagaacaaggttaaataaaagtggtgttggtgggcgtccttatttctgatattaatgggaatgagtataatgtataaatatataaccatgattttggtttttttccaagtttttatcagtaatgattgctgagttttatcaaaatttttttggcatccattgagaggattatatattactctttgacacattaatgtggttaattaaagtaaccaacttattaaccttgaaatagtcttagttaaataaaccctacttgtcaatgctatatcattattttaatattgtactgaacattttacaaaggtgtttcaccataaggcatattgatctgtaatttttttttttctgttgaacttgctattgtcaggttttggtgtattatgttggttttggagaataaatttaaaagtttcctttatgttatctatacattgcctgaaaagagtttaaatagcattgaaaatgatctcttctttgaagatttaaccaatttcacctgtaaatctgtctgtgctttgtaattttggtgatactgttgactcaaattccaaaagcagtaaatgcagtgttttatatttttctattaaaaatgtaaaatcaaattatattactcatttgtatatagtctttgatttttttctaaagaatgagcccttattttatcataagctcagtgaagaagttgctacagttgtacttttttatttcccacctaatacactactctcagataatgtaccacatgacacacctatctgtgaatatcagaatctgaagttatatatcatgtgtaggccaatctcttaagctctgaatttatttgttcagctactcgatatattcacttagctattccataagctattccataagcacttcaaattcaatatatttagttcattatctgctcccctcttgctattgccaagtttaaaatagtaatttcctccctttcccttgcttcccacatccaatcaattaccatgcccctttacctcagttttctaaataactttaaaatctacccatctctctccattttcccagccactaccttagt

SEQ ID NO: 357859 - DNA, 2895 bp, Homo sapiens
agtttttgccaatctaaaaggtgaaaatattttatcttgcatgaataaagttgaatattttttctttttttcccttaatcgtttgcatttcttctactgggttgtctttttaactgatgcataagagctttttaaattttctcttttttaagagttaggatcttgctgtgtggcttaactctcaaactcttgggctctagcagtcctcccaccttagcctcccgagtagctgggactacaggcatgtgctgctgtgtgcagcagatgtgtacaaaagagctttaaaggtagtactgaaaacagttcctttatagttctatgttgaaaataatttcttcccacttttttattgtcttaatttacagattttttgctgtgcagtaggttttatgttgtcaaatgtattaatcttttaacctaggttttaagttaaaatgctttccccatgctaagatttttaaaaagaaaaactcttccatgtttcctaatatttatactgtttcaaatttttatgttcaaatctttgatccatctgaaattcactttggtgtaaggaataaggaagcattctaaatagatgtcatacacatcaacaaatatatatatatagcccccacccaaatgtggatgtaaactgtttctacatcattattgaataatccatcctctcacccactgatctgaaatctcactgttgctatatactatggtcctatgtggattagcatctacgcctggattctctattcgctcctctgactattcctggcccagtaacttgtctgacaagttcagttttacagtatgttttgttctctagtaaagcagcacacccttgctctcccaactcttccttttcagttttcttggctattcttgagggtttttttccagataaacttcaataaacgtgtatcaaggtccaaaatgaacgctggtaggtttttttttttttcgagttggggtctcactctgtcgcctaggctggagtgcagtggcgtggatctctgctcactgcaagctccgcctcccgggttcatgccattctcctgactcagcctccggagtagcggggactacaggcgcacgccaccaggcccggctaatttttttttttgtatttttagtagagacggggtttcaccgcgttagccagaatggtttctatctcctgacctcatgatccgcccacctcggcctcccaaagtgctgggattacaggcgtgagccactgtgcctggccaaacgctggtaggttttgagtgagaccacattacatttaaatatatttacaatgttttctgctctattctttagtagacttttcctcacgtggtcctacgcatttctttctaagtttattttcatatagcctatccctgtctacaatttaaattgggatcttctatattctagttattatttgtaaataagaaaactactgacttttttctagtatattttctcagaataggattttctatttttctataaaatgaccaatgttatgaagcttcgtaagttttgtcaaagtgatacacacatacagcaaaaaatcaaatagtacagaagtataaaagcaacaacctctgccttgccccttctccaccttcaggtccccttcccagatacaataatttttagctttttatttttaattattctggttgttacctacataactctgggcaatatggaaaagttattgattttgtatattaatttcataatcagttaccttgatgaattctcttgtttctagtagtttttctttagggttttaaagggatacaatcataccatttgcagttagtaaccattttatctcctcttatttccaacttcgtactgttttctcttgtctaatttgtttttaattggtgggtacttctagaacaaggttaaataaaagtggtgttggtgggcgtccttatttctgatattaatgggaatgagtataatgtataaatatataaccatgattttggtttttttccaagtttttatcagtaatgattgctgagttttatcaaaatttttttggcatccattgagaggattatatattactctttgacacattaatgtggttaattaaagtaaccaacttattaaccttgaaatagtcttagttaaataaaccctacttgtcaatgctatatcattattttaatatttttctgttgaacttgctattgtcaggttttggtgtattatgttggttttggagaataaatttaaaagtttcctttatgttatctatacattgcctgaaaagagtttaaatagcattgaaaatgatctcttctttgaagatttaaccaatttcacctgtaaatctgtctgtgctttgtaattttggtgatactgttgactcaaattccaaaagcagtaaatgcagtgttttatatttttctattaaaaatgtaaaatcaaattatattactcatttgtatatagtctttgatttttttctaaagaatgagcccttattttatcataagctcagtgaagaagttgctacagttgtacttttttatttcccacctaatacactactctcagataatgtaccacatgacacacctatctgtgaatatcagaatctgaagttatatatcatgtgtaggccaatctcttaagctctgaatttatttgttcagctactcgatatattcacttagctattccataagctattccataagcacttcaaattcaatatatttagttcattatctgctcccctcttgctattgccaagtttaaaatagtaatttcctccctttcccttgcttcccacatccaatcaattaccatgcccctttacctcagttttctaaataactttaaaatctacccatctctctccattttcccagccactaccttagt

SEQ ID NO: 357860 - DNA, 1396 bp, Homo sapiens
tgacgtcagcgccgccgcggtgatttaacagcttttgttttgggcagaagaacctatgggcacaaaaagcaggaacgagtagcggtggctgaagaacgagcaggagcttgaatttcagttttcttatgaggaattttccagaaaagatatcttcactgtgaaataactaaataaatgcccactcagtacaacaaaaatacctgctacatgcttccttctgtatgaatacatgagacctaccttcattcatgtttcctctatgaagctttccctgcactccaaacacagagctgagacttccacctaatgtagaaagctagcacgagccggcgctgacagatggaagacttgagatgttacaagattatatatggaaacacaaaaggagtggagttgctgggtcatatggcaattcatttgaggaactgagaagcttattccatggaggctgaactgttttatattcccaccagcaacgtgtaaggttccagtttatctacatcatcaccaacacttgctattttccatttcattaatgatagccatcctagtggatttgaagtggtaccttattatcgtggttttgattgcattctctattgactaatgatatcgagcatcttttcatgtattttttggtcatttggtcatttttcttttttaattttaaaattttgagacaggctctcactatgttgcccaggtggtctcaaactcctgggttccagcgatgctcatgcctcagtctcccaaaggggtgggattacaggtgtgagccactttgcccagcccatttgtatatctcctttggagaatatctaggttcttttgaaggtagctgcatataaactagccaaattaacagactgtggtttttagatggctttccatatctacaagaactatttagttctcaaaactgggaagaaatgtttcagaggcatcattaattcataatctaaaaatttatcttgggtttccttttttcccccagattctgtatcctccatagtcctattcatgacatgggtcgttcatctctgtattctaaaccctcaatgaactgtagacagtaataaatatttattggatgaatggtctctcatcagctactcgggaggctgaggcgggagaattgcttgggcctgggaggcagaggttgcagtgagctgagatcatgccaccgcactccaaccagggcaacagatcaagactccatcttggggaaaaaaaaaaaaattagccaggcttggtggtggatgcctgtgttcccagcttcttgggagactgaagcaggaggatcgcttgagcccaggaggcggaggttgcagtgagttgagattgtgccactgtactccagcctgggcaacagaaacaatactccgtctcaaaaaaa

SEQ ID NO: 357861 - DNA, 1102 bp, Homo sapiens
tgacgtcagcgccgccgcggtgatttaacagcttttgttttgggcagaagaacctatgggcacaaaaagcaggaacgagtagcggtggctgaagaacgagcaggagcttgaatttcagttttcttatgaggaattttccagaaaagatatcttcactgtgaaataactaaataaatgcccactcagtacagtcactgtctcccttttggaacttgatggcaccttaagcccaggtttgcctccactctagaaactcatcagagtgatgcccttctcaaatgggggaggtcccaaagcggatatcctggcagtgtgaaaggccggctaaaggtttgtgccaagaggatctgtggaatgcatctcctacagctggtgctgctgagtaaccactctgatctggcatcttctttgatcaagttacagagcagagtttccagggctggggattgaagtcctgcctcctccctttgtctctggttgtcctcgctttccctgcactccaaacacagagctgagacttccacctaatgtagaaagctagcacgagccggcgctgacagatggaagacttgagatgttacaagattatatatggaaacacaaaaggagtggagttgctgggtcatatggcaattcatttgaggaactgagaagcttattccatggaggctgaactgttttatattcccaccagcaacgtattctgtatcctccatagtcctattcatgacatgggtcgttcatctctgtattctaaaccctcaatgaactgtagacagtaataaatatttattggatgaatggtctctcatcagctactcgggaggctgaggcgggagaattgcttgggcctgggaggcagaggttgcagtgagctgagatcatgccaccgcactccaaccagggcaacagatcaagactccatcttggggaaaaaaaaaaaaattagccaggcttggtggtggatgcctgtgttcccagcttcttgggagactgaagcaggaggatcgcttgagcccaggaggcggaggttgcagtgagttgagattgtgccactgtactccagcctgggcaacagaaacaatactccgtctcaaaaaaa

SEQ ID NO: 357862 - DNA, 574 bp, Homo sapiens
agagatggggtttcactatgttgttcaggctggtcttaaactcctgggctcaaatgatcctctgtctcagcctccaaaagtgctggaattacagtcatgagccactgcaactgaattgcctttttttttttaaagagacattcttgctatgctgcccagctggagtgtagtggtgggatcacagctcactgcaggttcaacctcctgggctcaagtgatccctcaggctcaggtgatccccctgccttagcctccagagtaagtaggactataggctagcctccagagtaggtaggactatatgcccagctaatccagataccctttttattaaaaatctgaaaatcaggctgggaccagtggctcacacctgtaattgcagcactttgggaggacaaggtgggtggatcatgaggtcgggagttcgagaccagcctgaccaatatggtaaaaccccatctctactacaattacaaaaattagccaggtgtggtggcatgcacctgtagttccagctactcggaaggctgaggcaggagaatcgcttgaactcaggaggtggaggttgcagtga

SEQ ID NO: 357863 - DNA, 314 bp, Homo sapiens
ttatgacaactgtttctatgcatatgaaccaagcaaccaaatatctataaccatggaaatatctgattagaaatatttctaatttgggccgggctcggtggctcacgcctataatcccagcactttgggaggccaaggcaggcggatcacctgaggtcgggagttcgagaccagcctgaccaatatggtaaaaccccatctctactacaattacaaaaattagccaggtgtggtggcatgcacctgtagttccagctactcggaaggctgaggcaggagaatcgcttgaactcaggaggtggaggttgcagtga

SEQ ID NO: 357864 - DNA, 427 bp, Homo sapiens
ggcagattgtttcagctcttcaattcgagatcaaccccgggcaacatggtgaaaccccatctctacaaaaaatgcacaaatgagtcaggtgtggtggcacatgcctgtagtcccagctttttgggaggctgaggtggaggatggcttcagcctaggaggcagaggatgcagtgagccaagagcatgccactgcactccagcatgggccacagagactaaccttgtctcagaaaaaaagaaaatgaggttcttgatttataaaactggaaaaggccaggcacagtggctcacacctgtaatcccagcacagattactctgggcaacagagcaagactctgtccctccccctcaaaaaaataagttaaataaaaaataaaataaaactgaaacagaaggaccacacaaaccccaaagcaacaacaacaa

SEQ ID NO: 357865 - DNA, 186 bp, Homo sapiens
caggagttaggaacacaggttccaagcagcctgatttcaaatcctggttccatctctcactagctggccaagggacttgcctcctctgtggaagtggtcttggaagtgggctagcacacctatcccagtctcacaggctactgtgaaggcaacatggaacgcagagtgtgaacacagtccctggtg

SEQ ID NO: 357866 - DNA, 708 bp, Homo sapiens
ccaatttaaactcactgtgatagcacacgtcgtgacggatttgggtggtggtttcctttccagttggctctaagaataatgtattaagccagaccacaatcagatgccaagcccatgattagctttctctctccacttgggtcgcttttgttttttgagcagatatgcagtgctggatacagccatttgtgggtgggctgaggatgggctctgttaaaagagatgtgataatggctgtgaaaatccattttaagtgctgcaacccttgttgctttaaatgttatctgtgaatttcctgctaagggttgcatttctgtaatagtgattgcaaactggtggcccctgggccaaatatggctcacagatgtgttttatttggccagctcagtgttataaaagcatctgaatttgtggccaatatttacatattaagagatgctacacaaaaatctagatttcggtcttctcatgagaaactcgatgtgaccacattgggcccacttttccatgtggcaacaattggctggggctgagttgcagctggctctttgagacagagtatgtaccatctggttagcataatatctatccagctcacttctcccatttaggtaacttgctgcatctctgtgagtgtttagattttcaacactggtttatcaagatcaagagatcaaagatcaagagatcttaattatctaagcttct

SEQ ID NO: 357867 - DNA, 435 bp, Homo sapiens
aaccaaattaataaataaaaatataaaagagaaaagatagtccgactctgttccccaggctgttgtgcagtggcctgatcttgctcactgcaacctccgcctcctgtgcggtcctaccacctcagcctctcaagtagctgggaccacaagtgccaaccaccatgcctggctaatgatataaaaccaattgacaggggctggggtgcatacagggttggatgtaaatgagcttgcacgttactttggatcatcagtttcgaagtcagcatgtcgtatatgtgtatatggatgtattttctatgtgttaggtatttccattcacctctgctgactgacccaattgggaggtggcagggaggagatcgctagttgactgggctaatggaaagtcaactaaacttataaagcctgaaattgggaacagattgtgaggac

SEQ ID NO: 357868 - DNA, 1023 bp, Homo sapiens
  misc_feature (975)..(975): n is a, c, g, or t
cctacctcagcctcccgagtagctgggattacaggcatgcaccaccaagccaggctaattttttctatttttagtagagacggggtttctccacattggtcaggctggtctcgaactcctgacctcaggtgatccacctgcctcggcctcccaaagtgctgggattacaggtgtgagtcactgcacctggccaaaaatatattcttaattaacagtattatgttattcataaatataggttgtctcatgatacagacttgtcttcctcaatttagtagttcaactaaataaagaagttttcctaagcagcccagcaaatcattctgcagcagatactatttccagtatttgtagttttggtcattttgaacaaagctgtcagtaaaagctgctgaaattccaaggatgggtgtgaggagggcatgcttcataccacatattctgtgataaggagtggtaggggccatggcatgcatgatggtgctaccaccctgacgttgatcctgggcaggataattgccacttggttatataaaggcagataagctccctgtttttgtggggtagaagaaatagaaaaccggaaatattgactttaggccaggccttttcactatttatttttctaaatactccctggcttacggccttaggtataaagtctctgcccagctttcaagacattttaagctttcatgtttcttgtcagccatgattattctgtataatcaatgctttaaaagaacatagaaattcctatatgtacatgcatgttttcacaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtgaccaagggagggaggaaggaaggangcaaggaaggaagggagggagggagggagggagagaggctgtgccgaa

SEQ ID NO: 357869 - DNA, 639 bp, Homo sapiens
acaaaacaaaaaacagccaggcatgatagtatgtgcctatcctagccaggtagctgagaggccaaggcaggaaaatggcttgagcccaggagtttaaggttgtagtgagctgtgatcatgccacccactccagcctgtacaacagagaccctatctctaaaaaaatagaaactttattaaaactattttcagttctttggtcatgaccttggctgtctttgtcagaagtcatgggaaatattgcaagttttcatttggttaaggtttggggttaattttggaattggctctgctcttccaggtttgttgaatgtacagagtgcggaagaaagatgcatcagatctgtgtccttcaccatgagatcatctggcctgctgggtaagtcttaacgttgttactttctctggaatttttctttatcgtgaatattaacaagttttttattctatgcaattgactgtattatatcttcaaagttactatctttaaattgttttctttgggtttggccacgataattatagttcgctttttaaaaattaagtaacctagtatccaaaaatagatttttatcttatttttatgcattcttcttagccatataaatatattttattctgctggattgtttattaaaa

SEQ ID NO: 357870 - DNA, 6061 bp, Homo sapiens
ctcaggccattgctgagaagcagccttcccaggaagtgaagatggaggccaaaatggaagtggatcaaccagaaccagcagatactcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaacattggaggcactttaccgtcaggatccagaatcccttccctttcgtcaacctgtggaccctcagcttttaggaatccctgattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttagaatatgtcaagaaattaggttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccccccccacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaaaaaaaaaaaaaaaaacaaaaaacaaaacaacaaaacaaaaacaaacaaaaacaaaaaaaacaccaacacaaacacacaaccaacaacaacaacacaacaacacaccaccaaaccacacccaccccccccaccacaccccccagaagcagcgatgaagcaacagagaactgcagcaggcggcgggcgccgcgcgcaggcaacgcgcgccagcaggcgaggggcaccagcggacgggagcaccaagcaggacagacaaacacagggcggcacagccgcgacagaccagaacgcgcgcggcacccccggcaggcaacagcagaaagaggacagcgccacaagcaacaagagcaggaaacaagacagaccagacgaatggaaactcacacaggccgcaaccggcacagacaccgcagcagagcaggcacgagcaaaaagcccaggacagagcggcaggcagggacagacagacacacagacgcagccaccacagcacaggccagacgcaagtcgcggcagagaccaacacgaacacgaagccacaggcaagtgcagcaagaagtaccagcagagagcaagaccgaagagacaga

SEQ ID NO: 357871 - DNA, 6062 bp, Homo sapiens
ctcaggccattgctgagaagcagccttcccaggaagtgaagatggaggccaaaatggaagtggatcaaccagaaccagcagatactcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaacattggaggcactttaccgtcaggatccagaatcccttccctttcgtcaacctgtggaccctcagcttttaggaatccctgattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttagaatatgtcaagaaattaggttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacagcagacgcctcagcaacagttgtgactgtggttgagccttacttggaccctgatagagatccccctcgtgctcaaggatcttcttgtctgaccatcagtgctgcttctagggggggtgccagatgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccccccccacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaaaaaaaaaaaaaaaaacaaaaaacaaaacaacaaaacaaaaacaaacaaaaacaaaaaaaacaccaacacaaacacacaaccaacaacaacaacacaacaacacaccaccaaaccacacccaccccccccaccacaccccccagaagcagcgatgaagcaacagagaactgcagcaggcggcgggcgccgcgcgcaggcaacgcgcgccagcaggcgaggggcaccagcggacgggagcaccaagcaggacagacaaacacagggcggcacagccgcgacagaccagaacgcgcgcggcacccccggcaggcaacagcagaaagaggacagcgccacaagcaacaagagcaggaaacaagacagaccagacgaatggaaactcacacaggccgcaaccggcacagacaccgcagcagagcaggcacgagcaaaaagcccaggacagagcggcaggcagggacagacagacacacagacgcagccaccacagcacaggccagacgcaagtcgcggcagagaccaacacgaacacgaagccacaggcaagtgcagcaagaagtaccagcagagagcaagaccgaagagacaga

SEQ ID NO: 357872 - DNA, 6305 bp, Homo sapiens
ctcaggccattgctgagaagcagccttcccaggaagtgaagatggaggccaaaatggaagtggatcaaccagaaccagcagatactcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaacattggaggcactttaccgtcaggatccagaatcccttccctttcgtcaacctgtggaccctcagcttttaggaatccctgattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttagaatatgtcaagaaattaggttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggtaggcaccgggttgtgggaaggaggaggtgagctccgcagggttgttctgaggggccatgcagccacgtattttatagaggcctgtgggatgctaggggcttggcctcgtgtttgaggggcagagctgaagaggctagtttttgttctacgaaaggggcttttctagcccaaacaatatctaaaatacttttgaatgacttaaatcttggagagtttacgtgcacctcctgttttttccctaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccccccccacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaaaaaaaaaaaaaaaaacaaaaaacaaaacaacaaaacaaaaacaaacaaaaacaaaaaaaacaccaacacaaacacacaaccaacaacaacaacacaacaacacaccaccaaaccacacccaccccccccaccacaccccccagaagcagcgatgaagcaacagagaactgcagcaggcggcgggcgccgcgcgcaggcaacgcgcgccagcaggcgaggggcaccagcggacgggagcaccaagcaggacagacaaacacagggcggcacagccgcgacagaccagaacgcgcgcggcacccccggcaggcaacagcagaaagaggacagcgccacaagcaacaagagcaggaaacaagacagaccagacgaatggaaactcacacaggccgcaaccggcacagacaccgcagcagagcaggcacgagcaaaaagcccaggacagagcggcaggcagggacagacagacacacagacgcagccaccacagcacaggccagacgcaagtcgcggcagagaccaacacgaacacgaagccacaggcaagtgcagcaagaagtaccagcagagagcaagaccgaagagacaga

SEQ ID NO: 357873 - DNA, 4356 bp, Homo sapiens
tcaagctatacggctaggtagcgtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccccccccacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaaaaaaaaaaaaaaaaacaaaaaacaaaacaacaaaacaaaaacaaacaaaaacaaaaaaaacaccaacacaaacacacaaccaacaacaacaacacaacaacacaccaccaaaccacacccaccccccccaccacaccccccagaagcagcgatgaagcaacagagaactgcagcaggcggcgggcgccgcgcgcaggcaacgcgcgccagcaggcgaggggcaccagcggacgggagcaccaagcaggacagacaaacacagggcggcacagccgcgacagaccagaacgcgcgcggcacccccggcaggcaacagcagaaagaggacagcgccacaagcaacaagagcaggaaacaagacagaccagacgaatggaaactcacacaggccgcaaccggcacagacaccgcagcagagcaggcacgagcaaaaagcccaggacagagcggcaggcagggacagacagacacacagacgcagccaccacagcacaggccagacgcaagtcgcggcagagaccaacacgaacacgaagccacaggcaagtgcagcaagaagtaccagcagagagcaagaccgaagagacaga

SEQ ID NO: 357874 - DNA, 4213 bp, Homo sapiens
  misc_feature (25)..(26): n is a, c, g, or t
gactctagagatcccagtcgcgttnntgagaagataaagaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccccccccacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaaaaaaaaaaaaaaaaacaaaaaacaaaacaacaaaacaaaaacaaacaaaaacaaaaaaaacaccaacacaaacacacaaccaacaacaacaacacaacaacacaccaccaaaccacacccaccccccccaccacaccccccagaagcagcgatgaagcaacagagaactgcagcaggcggcgggcgccgcgcgcaggcaacgcgcgccagcaggcgaggggcaccagcggacgggagcaccaagcaggacagacaaacacagggcggcacagccgcgacagaccagaacgcgcgcggcacccccggcaggcaacagcagaaagaggacagcgccacaagcaacaagagcaggaaacaagacagaccagacgaatggaaactcacacaggccgcaaccggcacagacaccgcagcagagcaggcacgagcaaaaagcccaggacagagcggcaggcagggacagacagacacacagacgcagccaccacagcacaggccagacgcaagtcgcggcagagaccaacacgaacacgaagccacaggcaagtgcagcaagaagtaccagcagagagcaagaccgaagagacaga

SEQ ID NO: 357875 - DNA, 4844 bp, Homo sapiens
tgtgcatttcagttctatttatagtcagtctcaagagaccaaagaggtaaagcaggaaaaggaacaggaggcgtatggtggtgaaactaactcagcattcgccagtctcattggtgctcagcctgctgtacctgctcacacctgtaatcccagcactctgggaggctgaggcaggcagatcacttgagcttaggagtttgagaccagcctgggcaacatggcgaagcctcgtctctacaaaaaatgcagaaattagccaggtgtggtggtgtgggcctgtggtctcagctattcaggaggccatggtgggataattgcttgagcccaggaggcagaggttgtagtgagccaagatcacgccactgcattccagcctggatgacagagcgaggccctgtctcaaaaaaaagagactgtctgtttttcaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggtaggcaccgggttgtgggaaggaggaggtgagctccgcagggttgttctgaggggccatgcagccacgtattttatagaggcctgtgggatgctaggggcttggcctcgtgtttgaggggcagagctgaagaggctagtttttgttctacgaaaggggcttttctagcccaaacaatatctaaaatacttttgaatgacttaaatcttggagagtttacgtgcacctcctgttttttccctaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccccccccacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaaaaaaaaaaaaaaaaacaaaaaacaaaacaacaaaacaaaaacaaacaaaaacaaaaaaaacaccaacacaaacacacaaccaacaacaacaacacaacaacacaccaccaaaccacacccaccccccccaccacaccccccagaagcagcgatgaagcaacagagaactgcagcaggcggcgggcgccgcgcgcaggcaacgcgcgccagcaggcgaggggcaccagcggacgggagcaccaagcaggacagacaaacacagggcggcacagccgcgacagaccagaacgcgcgcggcacccccggcaggcaacagcagaaagaggacagcgccacaagcaacaagagcaggaaacaagacagaccagacgaatggaaactcacacaggccgcaaccggcacagacaccgcagcagagcaggcacgagcaaaaagcccaggacagagcggcaggcagggacagacagacacacagacgcagccaccacagcacaggccagacgcaagtcgcggcagagaccaacacgaacacgaagccacaggcaagtgcagcaagaagtaccagcagagagcaagaccgaagagacaga

SEQ ID NO: 357876 - DNA, 2212 bp, Homo sapiens
attgcataagggtgtgggacgctgtgtttctctttcacttgttccaggtctcaagccagccagtaagtgtctcagtgtcctcagaagaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccccccccacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaaaaaaaaaaaaaaaaacaaaaaacaaaacaacaaaacaaaaacaaacaaaaacaaaaaaaacaccaacacaaacacacaaccaacaacaacaacacaacaacacaccaccaaaccacacccaccccccccaccacaccccccagaagcagcgatgaagcaacagagaactgcagcaggcggcgggcgccgcgcgcaggcaacgcgcgccagcaggcgaggggcaccagcggacgggagcaccaagcaggacagacaaacacagggcggcacagccgcgacagaccagaacgcgcgcggcacccccggcaggcaacagcagaaagaggacagcgccacaagcaacaagagcaggaaacaagacagaccagacgaatggaaactcacacaggccgcaaccggcacagacaccgcagcagagcaggcacgagcaaaaagcccaggacagagcggcaggcagggacagacagacacacagacgcagccaccacagcacaggccagacgcaagtcgcggcagagaccaacacgaacacgaagccacaggcaagtgcagcaagaagtaccagcagagagcaagaccgaagagacaga

SEQ ID NO: 357877 - DNA, 1134 bp, Homo sapiens
ctcaggccattgctgagaagcagccttcccaggaagtgaagatggaggccaaaatggaagtggatcaaccagaaccagcagatactcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaacattggaggcactttaccgtcaggatccagaatcccttccctttcgtcaacctgtggaccctcagcttttaggaatccctgattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggtgtattccgggatcctctagatcg

SEQ ID NO: 357878 - DNA, 1113 bp, Homo sapiens
ctcaggccattgctgagaagcagccttcccaggaagtgaagatggaggccaaaatggaagtggatcaaccagaaccagcagatactcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaacattggaggcactttaccgtcaggatccagaatcccttccctttcgtcaacctgtggaccctcagcttttaggaatccctgattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtaagcttggccaggtgtggaccatggtccatgtgtccacatgtccagggagtgcatgcggatgggccagcacacatacagtcatggttcatgtgtatcttgcttgaagacagctgtatagcacaagttctgttttttgccttctgcctttgtttgcagaacaataaaattttctatcagagtagccttgcatcagttacctgggttcctcccaagagcttgagaagttaagcaactttgtgagttgttggcctagatgggtctatatcccaggccccacttctctttctactgtgtgtttgttgatcaccacagcctgaggcaaaactgagaagatttttaaacttttaactgaaactcgctagacagctttttggaaatatttcctttttagatgaggcctatccctaagt

SEQ ID NO: 357879 - DNA, 939 bp, Homo sapiens
gaaacccagtctttacacacacacacacctgggcacaatgccgaaacccagtctctacacacacaaacacacacctgggcaacatggtgaaacccagtccctacacacacacacacacacacatgcacacacctgggcaacatggtgaaacccagtccctacacacacagacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaaaaaaaaaaaaaaaaacaaaaaacaaaacaacaaaacaaaaacaaacaaaaacaaaaaaaacaccaacacaaacacacaaccaacaacaacaacacaacaacacaccaccaaaccacacccaccccccccaccacaccccccagaagcagcgatgaagcaacagagaactgcagcaggcggcgggcgccgcgcgcaggcaacgcgcgccagcaggcgaggggcaccagcggacgggagcaccaagcaggacagacaaacacagggcggcacagccgcgacagaccagaacgcgcgcggcacccccggcaggcaacagcagaaagaggacagcgccacaagcaacaagagcaggaaacaagacagaccagacgaatggaaactcacacaggccgcaaccggcacagacaccgcagcagagcaggcacgagcaaaaagcccaggacagagcggcaggcagggacagacagacacacagacgcagccaccacagcacaggccagacgcaagtcgcggcagagaccaacacgaacacgaagccacaggcaagtgcagcaagaagtaccagcagagagcaagaccgaagagacaga

SEQ ID NO: 357880 - DNA, 908 bp, Homo sapiens
aatggtctgagattccttatattcaggctttcttcattctccgtaaccacccttctctctgccactcctgctctactttccaaatcctactcaccagctcaaaacctgactcatctcccgtccccccacacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaaaaaaaaaaaaaaaaacaaaaaacaaaacaacaaaacaaaaacaaacaaaaacaaaaaaaacaccaacacaaacacacaaccaacaacaacaacacaacaacacaccaccaaaccacacccaccccccccaccacaccccccagaagcagcgatgaagcaacagagaactgcagcaggcggcgggcgccgcgcgcaggcaacgcgcgccagcaggcgaggggcaccagcggacgggagcaccaagcaggacagacaaacacagggcggcacagccgcgacagaccagaacgcgcgcggcacccccggcaggcaacagcagaaagaggacagcgccacaagcaacaagagcaggaaacaagacagaccagacgaatggaaactcacacaggccgcaaccggcacagacaccgcagcagagcaggcacgagcaaaaagcccaggacagagcggcaggcagggacagacagacacacagacgcagccaccacagcacaggccagacgcaagtcgcggcagagaccaacacgaacacgaagccacaggcaagtgcagcaagaagtaccagcagagagcaagaccgaagagacaga

SEQ ID NO: 357881 - DNA, 6165 bp, Homo sapiens
catgcctgctacatccactttcccagccatctataacagttgaaagacaggtcttacattgtccatctactactagcatagatgtgatttctcgacggccgattgctgagaagcatgccttcccaggaactcagtatggatgccgagattgtctgtagttcacccaggcaagccatacatcctcagaccggaggcagtctttcagacgtctgtagtggctagactcctcccctgggcgtctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaacattggaggcactttaccgtcaggatccagaatcccttccctttcgtcaacctgtggaccctcagcttttaggaatccctgattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttagaatatgtcaagaaattaggttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccccccccacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaaaaaaaaaaaaaaaaacaaaaaacaaaacaacaaaacaaaaacaaacaaaaacaaaaaaaacaccaacacaaacacacaaccaacaacaacaacacaacaacacaccaccaaaccacacccaccccccccaccacaccccccagaagcagcgatgaagcaacagagaactgcagcaggcggcgggcgccgcgcgcaggcaacgcgcgccagcaggcgaggggcaccagcggacgggagcaccaagcaggacagacaaacacagggcggcacagccgcgacagaccagaacgcgcgcggcacccccggcaggcaacagcagaaagaggacagcgccacaagcaacaagagcaggaaacaagacagaccagacgaatggaaactcacacaggccgcaaccggcacagacaccgcagcagagcaggcacgagcaaaaagcccaggacagagcggcaggcagggacagacagacacacagacgcagccaccacagcacaggccagacgcaagtcgcggcagagaccaacacgaacacgaagccacaggcaagtgcagcaagaagtaccagcagagagcaagaccgaagagacaga

SEQ ID NO: 357882 - DNA, 5281 bp, Homo sapiens
cctacctcagcctcccgagtagctgggattacaggcatgcaccaccaagccaggctaattttttctatttttagtagagacggggtttctccacattggtcaggctggtctcgaactcctgacctcaggtgatccacctgcctcggcctcccaaagtgctgggattacaggtgtgagtcactgcacctggccaaaaatatattcttaattaacagtattatgttattcataaatataggttgtctcatgatacagacttgtcttcctcaatttagtagttcaactaaataaagaagttttcctaagcagcccagcaaatcattctgcagcagatactatttccagtatttgtagttttggtcattttgaacaaagctgtcagtaaaagctgctgaaattccaaggatgggtgtgaggagggcatgcttcataccacatattctgtgataaggagtggtaggggccatggcatgcatgatggtgctaccaccctgacgttgatcctgggcaggataattgccacttggttatataaaggcagataagctccctgtttttgtggggtagaagaaatagaaaaccggaaatattgactttaggccaggccttttcactatttatttttctaaatactccctggcttacggccttaggtataaagtctctgcccagctttcaagacattttaagctttcatgtttcttgtcagccatgattattctgtataatcaatgctttaaaagaacatagaaattcctatatgtacatgcatgttttcacaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccccccccacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaaaaaaaaaaaaaaaaacaaaaaacaaaacaacaaaacaaaaacaaacaaaaacaaaaaaaacaccaacacaaacacacaaccaacaacaacaacacaacaacacaccaccaaaccacacccaccccccccaccacaccccccagaagcagcgatgaagcaacagagaactgcagcaggcggcgggcgccgcgcgcaggcaacgcgcgccagcaggcgaggggcaccagcggacgggagcaccaagcaggacagacaaacacagggcggcacagccgcgacagaccagaacgcgcgcggcacccccggcaggcaacagcagaaagaggacagcgccacaagcaacaagagcaggaaacaagacagaccagacgaatggaaactcacacaggccgcaaccggcacagacaccgcagcagagcaggcacgagcaaaaagcccaggacagagcggcaggcagggacagacagacacacagacgcagccaccacagcacaggccagacgcaagtcgcggcagagaccaacacgaacacgaagccacaggcaagtgcagcaagaagtaccagcagagagcaagaccgaagagacaga

SEQ ID NO: 357883 - DNA, 4600 bp, Homo sapiens
tgtgcatttcagttctatttatagtcagtctcaagagaccaaagaggtaaagcaggaaaaggaacaggaggcgtatggtggtgaaactaactcagcattcgccagtctcattggtgctcagcctgctgtacctgctcacacctgtaatcccagcactctgggaggctgaggcaggcagatcacttgagcttaggagtttgagaccagcctgggcaacatggcgaagcctcgtctctacaaaaaatgcagaaattagccaggtgtggtggtgtgggcctgtggtctcagctattcaggaggccatggtgggataattgcttgagcccaggaggcagaggttgtagtgagccaagatcacgccactgcattccagcctggatgacagagcgaggccctgtctcaaaaaaaagagactgtctgtttttcaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccccccccacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaaaaaaaaaaaaaaaaacaaaaaacaaaacaacaaaacaaaaacaaacaaaaacaaaaaaaacaccaacacaaacacacaaccaacaacaacaacacaacaacacaccaccaaaccacacccaccccccccaccacaccccccagaagcagcgatgaagcaacagagaactgcagcaggcggcgggcgccgcgcgcaggcaacgcgcgccagcaggcgaggggcaccagcggacgggagcaccaagcaggacagacaaacacagggcggcacagccgcgacagaccagaacgcgcgcggcacccccggcaggcaacagcagaaagaggacagcgccacaagcaacaagagcaggaaacaagacagaccagacgaatggaaactcacacaggccgcaaccggcacagacaccgcagcagagcaggcacgagcaaaaagcccaggacagagcggcaggcagggacagacagacacacagacgcagccaccacagcacaggccagacgcaagtcgcggcagagaccaacacgaacacgaagccacaggcaagtgcagcaagaagtaccagcagagagcaagaccgaagagacaga

SEQ ID NO: 357884 - DNA, 6040 bp, Homo sapiens
ctcaggccattgctgagaagcagccttcccaggaagtgaagatggaggccaaaatggaagtggatcaaccagaaccagcagatactcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaacattggaggcactttaccgtcaggatccagaatcccttccctttcgtcaacctgtggaccctcagcttttaggaatccctgattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttagaatatgtcaagaaattaggttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccccccccacacacacacacatttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaaaaaaaaaaaaaaaaacaaaaaacaaaacaacaaaacaaaaacaaacaaaaacaaaaaaaacaccaacacaaacacacaaccaacaacaacaacacaacaacacaccaccaaaccacacccaccccccccaccacaccccccagaagcagcgatgaagcaacagagaactgcagcaggcggcgggcgccgcgcgcaggcaacgcgcgccagcaggcgaggggcaccagcggacgggagcaccaagcaggacagacaaacacagggcggcacagccgcgacagaccagaacgcgcgcggcacccccggcaggcaacagcagaaagaggacagcgccacaagcaacaagagcaggaaacaagacagaccagacgaatggaaactcacacaggccgcaaccggcacagacaccgcagcagagcaggcacgagcaaaaagcccaggacagagcggcaggcagggacagacagacacacagacgcagccaccacagcacaggccagacgcaagtcgcggcagagaccaacacgaacacgaagccacaggcaagtgcagcaagaagtaccagcagagagcaagaccgaagagacaga

SEQ ID NO: 357885 - DNA, 3465 bp, Homo sapiens
ctcaggccattgctgagaagcagccttcccaggaagtgaagatggaggccaaaatggaagtggatcaaccagaaccagcagatactcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaacattggaggcactttaccgtcaggatccagaatcccttccctttcgtcaacctgtggaccctcagcttttaggaatccctgattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttagaatatgtcaagaaattaggttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaacacagccaacctaccctgtgcagcctcctgggaatccagtataccctcagaccttgcatcttcctcaggctcca

SEQ ID NO: 357886 - DNA, 1176 bp, Homo sapiens
ctcaggccattgctgagaagcagccttcccaggaagtgaagatggaggccaaaatggaagtggatcaaccagaaccagcagatactcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaacattggaggcactttaccgtcaggatccagaatcccttccctttcgtcaacctgtggaccctcagcttttaggaatccctgattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctgggtaagtcttaacgttgttactttctctggaatttttctttatcgtgaatattaacaagttttttattctatgcaattgactgtattatatcttcaaagttactatctttaaattgttttctttgggtttggccacgataattatagttcgctttttaaaaattaagtaacctagtatccaaaaatagatttttatcttatttttatgcattcttcttagccatataaatatattttattctgctggattgtttattaaaa

SEQ ID NO: 357887 - DNA, 955 bp, Homo sapiens
ccaaaatgctggaattacaggtgtgagccactgcgcccaacctaagtctctttttcttaatcgcctatgacctccttggatatctcactctactactaccaaaatgatggtggttggggtggatccatatctttgtattctttcaagagtgcctggcatttagcaagcactcagtaaatgtttatgacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaaaaaaaaaaaaaaaaacaaaaaacaaaacaacaaaacaaaaacaaacaaaaacaaaaaaaacaccaacacaaacacacaaccaacaacaacaacacaacaacacaccaccaaaccacacccaccccccccaccacaccccccagaagcagcgatgaagcaacagagaactgcagcaggcggcgggcgccgcgcgcaggcaacgcgcgccagcaggcgaggggcaccagcggacgggagcaccaagcaggacagacaaacacagggcggcacagccgcgacagaccagaacgcgcgcggcacccccggcaggcaacagcagaaagaggacagcgccacaagcaacaagagcaggaaacaagacagaccagacgaatggaaactcacacaggccgcaaccggcacagacaccgcagcagagcaggcacgagcaaaaagcccaggacagagcggcaggcagggacagacagacacacagacgcagccaccacagcacaggccagacgcaagtcgcggcagagaccaacacgaacacgaagccacaggcaagtgcagcaagaagtaccagcagagagcaagaccgaagagacaga

SEQ ID NO: 357888 - DNA, 977 bp, Homo sapiens
gatatgcttctaaagagggattcagtgaaattgtactggaggcgagaatttcttgacttagcgtaaaacacccaaaggaaaaaaaaaaaaaaagcatcattactatttgaggaattaacgtgccacccagaaaatcctcaggggtcagatgaggactgtcaaaaattctgcataagttcagtatattctaaattagacacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaaaaaaaaaaaaaaaaacaaaaaacaaaacaacaaaacaaaaacaaacaaaaacaaaaaaaacaccaacacaaacacacaaccaacaacaacaacacaacaacacaccaccaaaccacacccaccccccccaccacaccccccagaagcagcgatgaagcaacagagaactgcagcaggcggcgggcgccgcgcgcaggcaacgcgcgccagcaggcgaggggcaccagcggacgggagcaccaagcaggacagacaaacacagggcggcacagccgcgacagaccagaacgcgcgcggcacccccggcaggcaacagcagaaagaggacagcgccacaagcaacaagagcaggaaacaagacagaccagacgaatggaaactcacacaggccgcaaccggcacagacaccgcagcagagcaggcacgagcaaaaagcccaggacagagcggcaggcagggacagacagacacacagacgcagccaccacagcacaggccagacgcaagtcgcggcagagaccaacacgaacacgaagccacaggcaagtgcagcaagaagtaccagcagagagcaagaccgaagagacaga

SEQ ID NO: 357889 - DNA, 114 bp, Homo sapiens
ccctggcttggaagtgagtgggagaagaaaccttagagaaattcttggaaccagagtagaggtggtggtacacatggatacagatgatacagatgtttgtgtaacacaaaagga

SEQ ID NO: 357890 - DNA, 2780 bp, Homo sapiens
agctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcgggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgga

SEQ ID NO: 357891 - DNA, 2674 bp, Homo sapiens
agctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgga

SEQ ID NO: 357892 - DNA, 2654 bp, Homo sapiens
agctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgga

SEQ ID NO: 357893 - DNA, 2647 bp, Homo sapiens
agctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcgggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgga

SEQ ID NO: 357894 - DNA, 2544 bp, Homo sapiens
cagacatctaggcttgatctgaaatgggggactttctgggaggggacagaaggcccagaataccttccagtcatgccaagtgggccacccagagccctgtgattgctctactcatgggtctccctaactccttcatggtcctcgtctgcctaagaaacccattcttccactcggtcctctgaaccccaggaggaatggccacccctcccctcttctcttcttcttcatttctacttccccctcttccaccctcttctcagtcccagtctccctccacacttccatctgggccccactccacagtccacagccctccactctcccacattgagcagactcttgcaaactcaagcaagaattctccctcataccttccagctaccttcaatacaaattggcattagatgaatgagtgggtggggtgggagtgtggatgggcaggttggtggatggctaagtaggcagcaggataaatgggttaagtaaggaagattggacagatgacaggcagaggggcaggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgga

SEQ ID NO: 357895 - DNA, 672 bp, Homo sapiens
ctgaggatgtcgcaaaccaagggtacaggaaggaagggtgggaaccaatgttttgggtacagggggaagtggaagccagacagtttcctggtggagggtggctttaagccctggctgacagacatctaggcttgatctgaaatgggggactttctgggaggggacagaaggcccagaataccttccagtcatgccaagtgggccacccagagccctgtgattgctctactcatgggtctccctaactccttcatggtcctcgtctgcctaagaaacccattcttccactcggtcctctgaaccccaggaggaatggccacccctcccctcttctcttcttcttcatttctacttccccctcttccaccctcttctcagtcccagtctccctccacacttccatctgggccccactccacagtccacagccctccactctcccacattgagcagactcttgcaaactcaagcaagaattctccctcataccttccagctaccttcaatacaaattggcattagatgaatgagtgggtggggtgggagtgtggatgggcaggttggtggatggctaagtaggcagcaggataaatgggttaagtaaggaagattggacagatgacaggcagaggggcaggtaggtagatatgtgggtggatgcacaagtggatt

SEQ ID NO: 357896 - DNA, 2839 bp, Homo sapiens
tcggagcctgcggagggtggtggtggtggtggtggtggccctcgcccgcctcactcatgcctcctcctcctctgctctcgctcaggcgcctcggtggcggttggtcggcggttacgcggctggtggtcgcggcggccggggctcgctctcggggaggccggggcggatctcgcggcgcaggcggcggcggccgaggtggggtcgcgcggcggaggcggctcgagcttcgtgctgcgcgctcgctcttgggctcctcggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgga

SEQ ID NO: 357897 - DNA, 2760 bp, Homo sapiens
agctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcgggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgga

SEQ ID NO: 357898 - DNA, 2547 bp, Homo sapiens
cgccccaccaggtcacccgggagcagggaacaccaaggaacccagagtcgggcctctttcgagccctcgcttcctctcgcctggcttcttcggcgcgaaggatgaattggggttgttgaaaattgatcaaacaacccgatctctgtcagcgcctggacacttgctgggccccagctcgcagcctgggaagataagtggcacttcctgtctcgtaatcggatttgcgcgcacgaaccctcggagacgcacagggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgga

SEQ ID NO: 357899 - DNA, 1182 bp, Homo sapiens
agctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcgggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcgtgagtgtgggcctagtgcctcagcccccagtacctccatccccagtcctcaaatcatcccacatctccttga

SEQ ID NO: 357900 - DNA, 402 bp, Homo sapiens
aactctttttattggaatctcagtttgctaacccaaacaaaggaaccactaatcttttggtgacaacaactaaaccaaagtcactatctctggaactaaatagttcatttaaggcacagcctgaccactccctaatgctaatcccaactcctaagtaattactgaagtattgaaaagtgttctgattctatcttggtgtataaaaactttctattttcttctgcttatttgtgatgccactcctccttgttattcaatacattgctgaaacttacttctgtaaaatttttgtgatttgattgaatgaggactcccatgttactcagtcccttttctattctattcagactccttgtccacgccgcaccctttctggtcatttatctctgggacagttttaat

SEQ ID NO: 357901 - DNA, 281 bp, Homo sapiens
agacctcagcctgcagaagcagaatctccgtggtgggatccagagcttgtatcttggccaagccctcccagaagtttctaacatacactgaaggttctcctgcttcaagagccaagatcctcaggcacaaaatcaggcaacaggagtcctgggctctgcccttgcttgtggagttctggaaacgaatgcatttggagtaggtgatgtttaatgatcctttctgttctcaattcctgtaatacaaataaacaataaaatacttacatctttattatttacat

SEQ ID NO: 357902 - DNA, 474 bp, Homo sapiens
ttttttttttccctggacgtcaatgcattctcacttgtttttactggtaagactgaaaactttcacccactaaccttcaatttctatccatggctaattcattggtaatttcttgcaactttcagaaaaacagtaattctcaatttgacacaggtttgccaatatgcatttaaagacctcttacacttcaaaccttggacttgcagatatgaaaaataataacattctcagtattctactcttcacctttgccctgccctgagcactatctaaaaaccaatgacagaaatgaattgcaaacatagcatgaagcactgctgcaattaatcaacccagagcccaagggaggaattgtttctatttttaaatgcactgttactttaagggaaaagtctgtggagaaatatgaaaccaagctgcataatgaaaataaaaatgcatttggtgtcttcatctgtgcaaagacagtaatcc

SEQ ID NO: 357903 - DNA, 226 bp, Homo sapiens
agagatctatcatgtggtcagtggttcattcattcggtccgcaaacatttgtggtgcctcttctaagggcttccacatctctcatgctgctttccccagtgctttttgaccacctctttgtgtccatcttcactgttagactgactgtaagtttcttggttttattcgtatttgtatggccagtaactagggcagtgcctggtgcaggataatcactcagaaattg

SEQ ID NO: 357904 - DNA, 693 bp, Homo sapiens
gaatgctcaaggattattaaacaaagtaacttgaagagtggtagaataggagacataccttaacaaagcttaattatcaccctggagcaggaaacaatctctttgcctttaaatgtgccacttctctgaacctcatcaatgataacagccattccctcatagtctttttcactccagtaatatgtgcatttaggcagaaagcatgttcacctacattttctctctgcaggtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaagtaggagcttctggcatggcgtagatgttttcagcaagaaacttgctacctggagtagcagcttgatcctagaaccaatgtgaatatcaatgttgagcctgtgatgagcacactcacctggatgacaaatccctagtgacgcaggtctagcctttatgctggggaacacagtgaatgttgttcaccattcactctttctctggtgtctcgtactgtgtaagatactgaggcagcacattaaatgatggtgtcattcttctcttaat

SEQ ID NO: 357905 - DNA, 1025 bp, Homo sapiens
  misc_feature (416)..(416): n is a, c, g, or t
gcggcacagccggtcccggctgcggcttctggctgcgcggcctgcgcgcgcctcccgggcggattccagccccgagcgggacagcgcggcggggagcgacgagcctcgggtggttcatcccgccggagaggaatggcgagaacctggagtgttgactggcaaaacatttgcagacgcggtttttctggcaattaattggctccattaaaaattaggtagttggtggggacttcctcctgaactctggagccgagcgcattttgctcggtcttttcagccctgtttccgcgtcttccttccctgccacccgcaaattgccagctttcatccgtggctctgagtgcaaaagagctggggaaagccttaaccagcaattttcttttaaataaaactttgcttttaaaaaaaaaaaaaanaaaaaaaaaaaaaaaaaaaaacaaaacgacaggcgggggcggcggccccccctccccccccgcggcccccgcagaaccacgcatgagggaggaggaacaaagacacgcgcacaaccagaggatagtggaccacttaacaaccacagaagggacgaggcgaagaacaaacacacccgtgacagaggggcccaacacacgagtcgtggcgcggttgacagagggaagacaacacctaccccggcagggccgaataggaagcagcacaaccacacaacgaccatgacacgacagcgaggccagcaaacaacaaaccaaacaacagaacgcgaacgaatggatggtaagcaacgcagacggttacctactcaagcacacacaggaacgcacgaactgacctctagtcgatgatcagatagacttgatcatacaatatacgccgagggtaggcggatcgaacaaccagcgcacagcaccaacacgtcccgccccccgccgtcgcccacatacgcagacaccacacgaacccgcccgaccccccgaacccacgctcgtccgtctcccacaacgccaccacaccaccaccaagcggcgcccacccacaccacccgc

SEQ ID NO: 357906 - DNA, 6015 bp, Homo sapiens
  misc_feature (5172)..(5172): n is a, c, g, or t
  misc_feature (5192)..(5192): n is a, c, g, or t
ccaggctcaagtgagcctctcacctcagcctcacgagttgctgggaccacagacctctcacttgactatgcctctcagccagcaaatcttcagttccctcacataatgccccttgctgaagacatcaaaggttcttgcttccaaagtgggaataaacggaaccatgaaccttttattgctccagaaagatttggaaacagtagtgtgggctttggcagtaattcccattcccaagcaccagagaaagtgacgcttcttgtagatggcacacgttttgttgtgaatccacagattttcactgctcatccggataccatgctgggaaggatgtttggaccaggaagagagtacaacttcactcggcccaatgagaagggagagtatgagattgctgaaggcatcagtgcaactgtatttcgcacagtgctggattattacaaaaccggtatcatcaattgtcctgatggcatctctatcccagatcttagagatacttgtgattatctctgcattaattttgacttcaacactatccgatgtcaagatctgagtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggctttcaagatgaggacagaaattgcttacaattgctcagtttctcaacagaaagactcataagagtgccagcatggggtacatggagtgaagctgggtgggaagcatcatctgcacagtccctgtcctagtgcaggacttttctctgtatgttttcataccatgggatttttggatatcagtgtattttggttcttgaaatagcctaatagctgctcacacattgggtaggaatattataccaatgtcatccccaaaggaagggtgagctgaatggaaattaagcccagtcattttatttgatctattagctctgttatcagtgcatgatcacccagatcaccctcctcagcccacacagtgctgaaccatcttccctcctgttctccatggctattaatagtatagctaaatttagagtgcagagccagatataagtattttggaattatctcccagtttgtggtagaagctgactggaatacaggttgagtatctcttatccaaaatgctagggaccagaaaggtttcagattttttcagattttggaatacttaacagttgagcaccccaaatctgaaaggcttctgaacgtcatgtcagcactcaaaaaagtggattttggagcacttcaaatttcggatttttggatttgggatgctcatcctgtgtaggagaggctactcgattccatttaatgactgtcctagtcataatcatccaaagataaaagccaggtagatgttgaaagctctttccagggctgaaaaagtgttcttacgttctctgcatgtgactagcatcactgtggaaattaatgctctgttcttcactagaatgtagtaagtggttaaactgagctatcccccacctgatgactattggcatccatttgcaaggccaatggcctggattaagggttaggattatttgtagctagaaggtaattttatttctgtgaaactaattggctcatatttgaggttaggtgtggccttgaccttaccagtacatttatacccactaccagttgactagcccagataattgttaaatggtgcttcttttctgcttctcagtagacttccatgccattacaaaggaaatttgaattacctagtgtttgtatattccatgataactatgtataacttctgttacacagcttatgtattgttaacatttaagtgtaaaccatgccacagctaacacttaaaaatgaaaactaattagttcttgcttagggaaaatgccaggtatgaagtatggcatatacttgacactgtcctgtgtaaccctttactttgctcaggctttcaagattgagtcttttttcccccaaattaggttaacatgcatttgaccccaacctgtggggtttgagtaagctggaaatctgtgacggtaggctttctagtgtcacgaggtggtggtgactgaaggaaaagctgggatcacaggttccttctgatggagaggaaggtttatttctatgcccctcccaccaccctccacctagagctcacccaagcctgctccagtcccaggggcaggccattctgcaaaagcaggacctcacagaaacaagggctgggttgaggtcacccccttcagagttggttcctggccagatgggtaagaggcatttgtaattttaaaaatgtgaaacttgggtttggtgttttcttctaagtgcctaaataagcaagccaggctgttgatattttagccagagaaatcggcaagccaagattaacccgaatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagttgcccaaagggtccccctctaagtaaaacaaatattcagaccacaggctttaatgtaaactgtcaaaaagtgggatgtggaggatttttgttaagtgtcaatcgaagttaaaaagcaagggtttttggccaggcgtggtggctcacgcctgtaatcccagcactttgggaggccgaggccggcaaatcacctaaggtcaggagttcgagaccagcctggccaacatggtgaaaccccgtctctactaaaaatacaaaaaaattagcccggtgtggtggcaagtgcctgtagtcccagctacttgggaggctgaggcaggagaactgcttgaacccgggaggtagaggttgcagtgagccacgatcatgccactgcactccagcctgggcaacagagcaagactccatctcaaaaaagaaaaaaaaaaattaaaggttttggctgggtgcagtggctcatgccggtaatcccagcactttgggaggccaaggtgggaggatcacttgaggtcaggagtttcagactggcctgggcaacgtaaaaaattaaaaaaatagccaggcatggacatggtagtgcatacctgtggtcccagccactcaagaggctgagacaggatgattgcttgagcccaggaggatgaggctgcagtgagccatgatgacgctactgcactccagcctggatgacagggcaagaccctgtctcaatattttaagtcaagggtttgtagtaatgtattcagtgccacttcttgccatcactttgcaattattgaaatgggaatactgagctcagaaagcaaatatgatgctttcatgggagatggagccacatttgtgttctgggtgggatcactagtgcaggagaacattacattttcttctgaaggcaaaatgcttgtaggttttgcctctactttgtatttacttttaaaattgcacttgttcacctaccagtgtttacgaaatcctgtatttgggatgctttttctataataaaatattataatttgagaaaaaaaaaaaaaaaaaaaaaaaaaaaaaaaaaaaaaaaaaaaaaaaaaaanaaaaaaaaaaaaaaaaaaanaaaaagagaggggggggcggcgacgcaaagatatcatcctccgcaaggagagagcgaaccagagatcaggcgcgaccgccacacatatatgaaaggagaaaagagggcgcgccccacgtaggaggaggagtattcttatatatacaacgagagggggggggccggccgctaatataaaacaccacagcccagcgagggggaaaaaccgcggcacacagccgaggacactttggagaggagaagagcaaccccccacaacgggggggggagggcgaacaaagaagaggagagagaaacacccaccctcacccagcagatatattacagagatccagggggagaaaatacaacaacaatctcagagagagggtatgtagagggtggacacaccaaatgtcgatattattggtgcctagcagagaacgaaaaatttggcgacaagacgagttatcttttatcaaaaatatttttacggcggggctcccgctactctaaccggagatacacataaaaaaaaagaagagggaaaaagcaataacgagaggaaggagtaggaggaaaaagaagacaagaaaaaaaaaggagaggagggaaacagcaaaagcaaagagagaagaagaagaaaggaggcaaaaaagcagggagaagagaagagaggagaaaacaaaagagaaagaaacaaaaaaaaaaacaaaagacgacggacacaacagaaaaaaaaaaagcaaaagaaagagaacagaagcagaagaagacgaacaaacaaaacagaaaaaaagaggaacaaaaaaaaaacgaaacaaacaagagcgcaaacaacaag

SEQ ID NO: 357907 - DNA, 6271 bp, Homo sapiens
  misc_feature (5428)..(5428): n is a, c, g, or t
  misc_feature (5448)..(5448): n is a, c, g, or t
gcggcacagccggtcccggctgcggcttctggctgcgcggcctgcgcgcgcctcccgggcggattccagccccgagcgggacagcgcggcggggagcgacgagatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaagacctctcacttgactatgcctctcagccagcaaatcttcagttccctcacataatgccccttgctgaagacatcaaaggttcttgcttccaaagtgggaataaacggaaccatgaaccttttattgctccagaaagatttggaaacagtagtgtgggctttggcagtaattcccattcccaagcaccagagaaagtgacgcttcttgtagatggcacacgttttgttgtgaatccacagattttcactgctcatccggataccatgctgggaaggatgtttggaccaggaagagagtacaacttcactcggcccaatgagaagggagagtatgagattgctgaaggcatcagtgcaactgtatttcgcacagtgctggattattacaaaaccggtatcatcaattgtcctgatggcatctctatcccagatcttagagatacttgtgattatctctgcattaattttgacttcaacactatccgatgtcaagatctgagtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggctttcaagatgaggacagaaattgcttacaattgctcagtttctcaacagaaagactcataagagtgccagcatggggtacatggagtgaagctgggtgggaagcatcatctgcacagtccctgtcctagtgcaggacttttctctgtatgttttcataccatgggatttttggatatcagtgtattttggttcttgaaatagcctaatagctgctcacacattgggtaggaatattataccaatgtcatccccaaaggaagggtgagctgaatggaaattaagcccagtcattttatttgatctattagctctgttatcagtgcatgatcacccagatcaccctcctcagcccacacagtgctgaaccatcttccctcctgttctccatggctattaatagtatagctaaatttagagtgcagagccagatataagtattttggaattatctcccagtttgtggtagaagctgactggaatacaggttgagtatctcttatccaaaatgctagggaccagaaaggtttcagattttttcagattttggaatacttaacagttgagcaccccaaatctgaaaggcttctgaacgtcatgtcagcactcaaaaaagtggattttggagcacttcaaatttcggatttttggatttgggatgctcatcctgtgtaggagaggctactcgattccatttaatgactgtcctagtcataatcatccaaagataaaagccaggtagatgttgaaagctctttccagggctgaaaaagtgttcttacgttctctgcatgtgactagcatcactgtggaaattaatgctctgttcttcactagaatgtagtaagtggttaaactgagctatcccccacctgatgactattggcatccatttgcaaggccaatggcctggattaagggttaggattatttgtagctagaaggtaattttatttctgtgaaactaattggctcatatttgaggttaggtgtggccttgaccttaccagtacatttatacccactaccagttgactagcccagataattgttaaatggtgcttcttttctgcttctcagtagacttccatgccattacaaaggaaatttgaattacctagtgtttgtatattccatgataactatgtataacttctgttacacagcttatgtattgttaacatttaagtgtaaaccatgccacagctaacacttaaaaatgaaaactaattagttcttgcttagggaaaatgccaggtatgaagtatggcatatacttgacactgtcctgtgtaaccctttactttgctcaggctttcaagattgagtcttttttcccccaaattaggttaacatgcatttgaccccaacctgtggggtttgagtaagctggaaatctgtgacggtaggctttctagtgtcacgaggtggtggtgactgaaggaaaagctgggatcacaggttccttctgatggagaggaaggtttatttctatgcccctcccaccaccctccacctagagctcacccaagcctgctccagtcccaggggcaggccattctgcaaaagcaggacctcacagaaacaagggctgggttgaggtcacccccttcagagttggttcctggccagatgggtaagaggcatttgtaattttaaaaatgtgaaacttgggtttggtgttttcttctaagtgcctaaataagcaagccaggctgttgatattttagccagagaaatcggcaagccaagattaacccgaatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagttgcccaaagggtccccctctaagtaaaacaaatattcagaccacaggctttaatgtaaactgtcaaaaagtgggatgtggaggatttttgttaagtgtcaatcgaagttaaaaagcaagggtttttggccaggcgtggtggctcacgcctgtaatcccagcactttgggaggccgaggccggcaaatcacctaaggtcaggagttcgagaccagcctggccaacatggtgaaaccccgtctctactaaaaatacaaaaaaattagcccggtgtggtggcaagtgcctgtagtcccagctacttgggaggctgaggcaggagaactgcttgaacccgggaggtagaggttgcagtgagccacgatcatgccactgcactccagcctgggcaacagagcaagactccatctcaaaaaagaaaaaaaaaaattaaaggttttggctgggtgcagtggctcatgccggtaatcccagcactttgggaggccaaggtgggaggatcacttgaggtcaggagtttcagactggcctgggcaacgtaaaaaattaaaaaaatagccaggcatggacatggtagtgcatacctgtggtcccagccactcaagaggctgagacaggatgattgcttgagcccaggaggatgaggctgcagtgagccatgatgacgctactgcactccagcctggatgacagggcaagaccctgtctcaatattttaagtcaagggtttgtagtaatgtattcagtgccacttcttgccatcactttgcaattattgaaatgggaatactgagctcagaaagcaaatatgatgctttcatgggagatggagccacatttgtgttctgggtgggatcactagtgcaggagaacattacattttcttctgaaggcaaaatgcttgtaggttttgcctctactttgtatttacttttaaaattgcacttgttcacctaccagtgtttacgaaatcctgtatttgggatgctttttctataataaaatattataatttgagaaaaaaaaaaaaaaaaaaaaaaaaaaaaaaaaaaaaaaaaaaaaaaaaaaanaaaaaaaaaaaaaaaaaaanaaaaagagaggggggggcggcgacgcaaagatatcatcctccgcaaggagagagcgaaccagagatcaggcgcgaccgccacacatatatgaaaggagaaaagagggcgcgccccacgtaggaggaggagtattcttatatatacaacgagagggggggggccggccgctaatataaaacaccacagcccagcgagggggaaaaaccgcggcacacagccgaggacactttggagaggagaagagcaaccccccacaacgggggggggagggcgaacaaagaagaggagagagaaacacccaccctcacccagcagatatattacagagatccagggggagaaaatacaacaacaatctcagagagagggtatgtagagggtggacacaccaaatgtcgatattattggtgcctagcagagaacgaaaaatttggcgacaagacgagttatcttttatcaaaaatatttttacggcggggctcccgctactctaaccggagatacacataaaaaaaaagaagagggaaaaagcaataacgagaggaaggagtaggaggaaaaagaagacaagaaaaaaaaaggagaggagggaaacagcaaaagcaaagagagaagaagaagaaaggaggcaaaaaagcagggagaagagaagagaggagaaaacaaaagagaaagaaacaaaaaaaaaaacaaaagacgacggacacaacagaaaaaaaaaaagcaaaagaaagagaacagaagcagaagaagacgaacaaacaaaacagaaaaaaagaggaacaaaaaaaaaacgaaacaaacaagagcgcaaacaacaag

SEQ ID NO: 357908 - DNA, 6139 bp, Homo sapiens
  misc_feature (5296)..(5296): n is a, c, g, or t
  misc_feature (5316)..(5316): n is a, c, g, or t
gcggcacagccggtcccggctgcggcttctggctgcgcggcctgcgcgcgcctcccgggcggattccagccccgagcgggacagcgcggcggggagcgacgagatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaagaaagatttggaaacagtagtgtgggctttggcagtaattcccattcccaagcaccagagaaagtgacgcttcttgtagatggcacacgttttgttgtgaatccacagattttcactgctcatccggataccatgctgggaaggatgtttggaccaggaagagagtacaacttcactcggcccaatgagaagggagagtatgagattgctgaaggcatcagtgcaactgtatttcgcacagtgctggattattacaaaaccggtatcatcaattgtcctgatggcatctctatcccagatcttagagatacttgtgattatctctgcattaattttgacttcaacactatccgatgtcaagatctgagtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggctttcaagatgaggacagaaattgcttacaattgctcagtttctcaacagaaagactcataagagtgccagcatggggtacatggagtgaagctgggtgggaagcatcatctgcacagtccctgtcctagtgcaggacttttctctgtatgttttcataccatgggatttttggatatcagtgtattttggttcttgaaatagcctaatagctgctcacacattgggtaggaatattataccaatgtcatccccaaaggaagggtgagctgaatggaaattaagcccagtcattttatttgatctattagctctgttatcagtgcatgatcacccagatcaccctcctcagcccacacagtgctgaaccatcttccctcctgttctccatggctattaatagtatagctaaatttagagtgcagagccagatataagtattttggaattatctcccagtttgtggtagaagctgactggaatacaggttgagtatctcttatccaaaatgctagggaccagaaaggtttcagattttttcagattttggaatacttaacagttgagcaccccaaatctgaaaggcttctgaacgtcatgtcagcactcaaaaaagtggattttggagcacttcaaatttcggatttttggatttgggatgctcatcctgtgtaggagaggctactcgattccatttaatgactgtcctagtcataatcatccaaagataaaagccaggtagatgttgaaagctctttccagggctgaaaaagtgttcttacgttctctgcatgtgactagcatcactgtggaaattaatgctctgttcttcactagaatgtagtaagtggttaaactgagctatcccccacctgatgactattggcatccatttgcaaggccaatggcctggattaagggttaggattatttgtagctagaaggtaattttatttctgtgaaactaattggctcatatttgaggttaggtgtggccttgaccttaccagtacatttatacccactaccagttgactagcccagataattgttaaatggtgcttcttttctgcttctcagtagacttccatgccattacaaaggaaatttgaattacctagtgtttgtatattccatgataactatgtataacttctgttacacagcttatgtattgttaacatttaagtgtaaaccatgccacagctaacacttaaaaatgaaaactaattagttcttgcttagggaaaatgccaggtatgaagtatggcatatacttgacactgtcctgtgtaaccctttactttgctcaggctttcaagattgagtcttttttcccccaaattaggttaacatgcatttgaccccaacctgtggggtttgagtaagctggaaatctgtgacggtaggctttctagtgtcacgaggtggtggtgactgaaggaaaagctgggatcacaggttccttctgatggagaggaaggtttatttctatgcccctcccaccaccctccacctagagctcacccaagcctgctccagtcccaggggcaggccattctgcaaaagcaggacctcacagaaacaagggctgggttgaggtcacccccttcagagttggttcctggccagatgggtaagaggcatttgtaattttaaaaatgtgaaacttgggtttggtgttttcttctaagtgcctaaataagcaagccaggctgttgatattttagccagagaaatcggcaagccaagattaacccgaatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagttgcccaaagggtccccctctaagtaaaacaaatattcagaccacaggctttaatgtaaactgtcaaaaagtgggatgtggaggatttttgttaagtgtcaatcgaagttaaaaagcaagggtttttggccaggcgtggtggctcacgcctgtaatcccagcactttgggaggccgaggccggcaaatcacctaaggtcaggagttcgagaccagcctggccaacatggtgaaaccccgtctctactaaaaatacaaaaaaattagcccggtgtggtggcaagtgcctgtagtcccagctacttgggaggctgaggcaggagaactgcttgaacccgggaggtagaggttgcagtgagccacgatcatgccactgcactccagcctgggcaacagagcaagactccatctcaaaaaagaaaaaaaaaaattaaaggttttggctgggtgcagtggctcatgccggtaatcccagcactttgggaggccaaggtgggaggatcacttgaggtcaggagtttcagactggcctgggcaacgtaaaaaattaaaaaaatagccaggcatggacatggtagtgcatacctgtggtcccagccactcaagaggctgagacaggatgattgcttgagcccaggaggatgaggctgcagtgagccatgatgacgctactgcactccagcctggatgacagggcaagaccctgtctcaatattttaagtcaagggtttgtagtaatgtattcagtgccacttcttgccatcactttgcaattattgaaatgggaatactgagctcagaaagcaaatatgatgctttcatgggagatggagccacatttgtgttctgggtgggatcactagtgcaggagaacattacattttcttctgaaggcaaaatgcttgtaggttttgcctctactttgtatttacttttaaaattgcacttgttcacctaccagtgtttacgaaatcctgtatttgggatgctttttctataataaaatattataatttgagaaaaaaaaaaaaaaaaaaaaaaaaaaaaaaaaaaaaaaaaaaaaaaaaaaanaaaaaaaaaaaaaaaaaaanaaaaagagaggggggggcggcgacgcaaagatatcatcctccgcaaggagagagcgaaccagagatcaggcgcgaccgccacacatatatgaaaggagaaaagagggcgcgccccacgtaggaggaggagtattcttatatatacaacgagagggggggggccggccgctaatataaaacaccacagcccagcgagggggaaaaaccgcggcacacagccgaggacactttggagaggagaagagcaaccccccacaacgggggggggagggcgaacaaagaagaggagagagaaacacccaccctcacccagcagatatattacagagatccagggggagaaaatacaacaacaatctcagagagagggtatgtagagggtggacacaccaaatgtcgatattattggtgcctagcagagaacgaaaaatttggcgacaagacgagttatcttttatcaaaaatatttttacggcggggctcccgctactctaaccggagatacacataaaaaaaaagaagagggaaaaagcaataacgagaggaaggagtaggaggaaaaagaagacaagaaaaaaaaaggagaggagggaaacagcaaaagcaaagagagaagaagaagaaaggaggcaaaaaagcagggagaagagaagagaggagaaaacaaaagagaaagaaacaaaaaaaaaaacaaaagacgacggacacaacagaaaaaaaaaaagcaaaagaaagagaacagaagcagaagaagacgaacaaacaaaacagaaaaaaagaggaacaaaaaaaaaacgaaacaaacaagagcgcaaacaacaag

SEQ ID NO: 357909 - DNA, 5773 bp, Homo sapiens
  misc_feature (4930)..(4930): n is a, c, g, or t
  misc_feature (4950)..(4950): n is a, c, g, or t
gcggcacagccggtcccggctgcggcttctggctgcgcggcctgcgcgcgcctcccgggcggattccagccccgagcgggacagcgcggcggggagcgacgagatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaaggtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggctttcaagatgaggacagaaattgcttacaattgctcagtttctcaacagaaagactcataagagtgccagcatggggtacatggagtgaagctgggtgggaagcatcatctgcacagtccctgtcctagtgcaggacttttctctgtatgttttcataccatgggatttttggatatcagtgtattttggttcttgaaatagcctaatagctgctcacacattgggtaggaatattataccaatgtcatccccaaaggaagggtgagctgaatggaaattaagcccagtcattttatttgatctattagctctgttatcagtgcatgatcacccagatcaccctcctcagcccacacagtgctgaaccatcttccctcctgttctccatggctattaatagtatagctaaatttagagtgcagagccagatataagtattttggaattatctcccagtttgtggtagaagctgactggaatacaggttgagtatctcttatccaaaatgctagggaccagaaaggtttcagattttttcagattttggaatacttaacagttgagcaccccaaatctgaaaggcttctgaacgtcatgtcagcactcaaaaaagtggattttggagcacttcaaatttcggatttttggatttgggatgctcatcctgtgtaggagaggctactcgattccatttaatgactgtcctagtcataatcatccaaagataaaagccaggtagatgttgaaagctctttccagggctgaaaaagtgttcttacgttctctgcatgtgactagcatcactgtggaaattaatgctctgttcttcactagaatgtagtaagtggttaaactgagctatcccccacctgatgactattggcatccatttgcaaggccaatggcctggattaagggttaggattatttgtagctagaaggtaattttatttctgtgaaactaattggctcatatttgaggttaggtgtggccttgaccttaccagtacatttatacccactaccagttgactagcccagataattgttaaatggtgcttcttttctgcttctcagtagacttccatgccattacaaaggaaatttgaattacctagtgtttgtatattccatgataactatgtataacttctgttacacagcttatgtattgttaacatttaagtgtaaaccatgccacagctaacacttaaaaatgaaaactaattagttcttgcttagggaaaatgccaggtatgaagtatggcatatacttgacactgtcctgtgtaaccctttactttgctcaggctttcaagattgagtcttttttcccccaaattaggttaacatgcatttgaccccaacctgtggggtttgagtaagctggaaatctgtgacggtaggctttctagtgtcacgaggtggtggtgactgaaggaaaagctgggatcacaggttccttctgatggagaggaaggtttatttctatgcccctcccaccaccctccacctagagctcacccaagcctgctccagtcccaggggcaggccattctgcaaaagcaggacctcacagaaacaagggctgggttgaggtcacccccttcagagttggttcctggccagatgggtaagaggcatttgtaattttaaaaatgtgaaacttgggtttggtgttttcttctaagtgcctaaataagcaagccaggctgttgatattttagccagagaaatcggcaagccaagattaacccgaatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagttgcccaaagggtccccctctaagtaaaacaaatattcagaccacaggctttaatgtaaactgtcaaaaagtgggatgtggaggatttttgttaagtgtcaatcgaagttaaaaagcaagggtttttggccaggcgtggtggctcacgcctgtaatcccagcactttgggaggccgaggccggcaaatcacctaaggtcaggagttcgagaccagcctggccaacatggtgaaaccccgtctctactaaaaatacaaaaaaattagcccggtgtggtggcaagtgcctgtagtcccagctacttgggaggctgaggcaggagaactgcttgaacccgggaggtagaggttgcagtgagccacgatcatgccactgcactccagcctgggcaacagagcaagactccatctcaaaaaagaaaaaaaaaaattaaaggttttggctgggtgcagtggctcatgccggtaatcccagcactttgggaggccaaggtgggaggatcacttgaggtcaggagtttcagactggcctgggcaacgtaaaaaattaaaaaaatagccaggcatggacatggtagtgcatacctgtggtcccagccactcaagaggctgagacaggatgattgcttgagcccaggaggatgaggctgcagtgagccatgatgacgctactgcactccagcctggatgacagggcaagaccctgtctcaatattttaagtcaagggtttgtagtaatgtattcagtgccacttcttgccatcactttgcaattattgaaatgggaatactgagctcagaaagcaaatatgatgctttcatgggagatggagccacatttgtgttctgggtgggatcactagtgcaggagaacattacattttcttctgaaggcaaaatgcttgtaggttttgcctctactttgtatttacttttaaaattgcacttgttcacctaccagtgtttacgaaatcctgtatttgggatgctttttctataataaaatattataatttgagaaaaaaaaaaaaaaaaaaaaaaaaaaaaaaaaaaaaaaaaaaaaaaaaaaanaaaaaaaaaaaaaaaaaaanaaaaagagaggggggggcggcgacgcaaagatatcatcctccgcaaggagagagcgaaccagagatcaggcgcgaccgccacacatatatgaaaggagaaaagagggcgcgccccacgtaggaggaggagtattcttatatatacaacgagagggggggggccggccgctaatataaaacaccacagcccagcgagggggaaaaaccgcggcacacagccgaggacactttggagaggagaagagcaaccccccacaacgggggggggagggcgaacaaagaagaggagagagaaacacccaccctcacccagcagatatattacagagatccagggggagaaaatacaacaacaatctcagagagagggtatgtagagggtggacacaccaaatgtcgatattattggtgcctagcagagaacgaaaaatttggcgacaagacgagttatcttttatcaaaaatatttttacggcggggctcccgctactctaaccggagatacacataaaaaaaaagaagagggaaaaagcaataacgagaggaaggagtaggaggaaaaagaagacaagaaaaaaaaaggagaggagggaaacagcaaaagcaaagagagaagaagaagaaaggaggcaaaaaagcagggagaagagaagagaggagaaaacaaaagagaaagaaacaaaaaaaaaaacaaaagacgacggacacaacagaaaaaaaaaaagcaaaagaaagagaacagaagcagaagaagacgaacaaacaaaacagaaaaaaagaggaacaaaaaaaaaacgaaacaaacaagagcgcaaacaacaag

SEQ ID NO: 357910 - DNA, 5952 bp, Homo sapiens
  misc_feature (5109)..(5109): n is a, c, g, or t
  misc_feature (5129)..(5129): n is a, c, g, or t
tccagggttcaagtgcttctcctgcctcagcctcccgagtagctgggattacaggcacccaccactatgcctaatttttctatttttagtagagacggggtttcaccatgttagtcaggctggtctccaactcccaacctcaactgatctgcctgcctcggcctcccaaagtgctgggttacaggtgtgagccaccacacccagccaaaacctttttagttttcaagagccattgtaatttccttttttgttaatagtgtttgtgccttttgcccattacaaaatcagattgttagttttttacttagtgatttgtgaaagctctatttgtggcagctctttctaattaaggaaattaaccttttatgagttgcaaatattttcttattcagtgtctttttagctttggtaaacggtttaggctatgcagagatgttgtatttctaaaatcatcagtttttcttttatggcttctaggtttaatgttgtacccagaaagtccccaccctgagactataaaaatttctcttacggtttatgtattatttaacatttaatctttgatccatctggattatttgggattaggagtcaagtatatccttcattagtttgattttgttagcttctctctttcctcttaggtctttactccatggctaaccctatattttttctttttcagttctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggctttcaagatgaggacagaaattgcttacaattgctcagtttctcaacagaaagactcataagagtgccagcatggggtacatggagtgaagctgggtgggaagcatcatctgcacagtccctgtcctagtgcaggacttttctctgtatgttttcataccatgggatttttggatatcagtgtattttggttcttgaaatagcctaatagctgctcacacattgggtaggaatattataccaatgtcatccccaaaggaagggtgagctgaatggaaattaagcccagtcattttatttgatctattagctctgttatcagtgcatgatcacccagatcaccctcctcagcccacacagtgctgaaccatcttccctcctgttctccatggctattaatagtatagctaaatttagagtgcagagccagatataagtattttggaattatctcccagtttgtggtagaagctgactggaatacaggttgagtatctcttatccaaaatgctagggaccagaaaggtttcagattttttcagattttggaatacttaacagttgagcaccccaaatctgaaaggcttctgaacgtcatgtcagcactcaaaaaagtggattttggagcacttcaaatttcggatttttggatttgggatgctcatcctgtgtaggagaggctactcgattccatttaatgactgtcctagtcataatcatccaaagataaaagccaggtagatgttgaaagctctttccagggctgaaaaagtgttcttacgttctctgcatgtgactagcatcactgtggaaattaatgctctgttcttcactagaatgtagtaagtggttaaactgagctatcccccacctgatgactattggcatccatttgcaaggccaatggcctggattaagggttaggattatttgtagctagaaggtaattttatttctgtgaaactaattggctcatatttgaggttaggtgtggccttgaccttaccagtacatttatacccactaccagttgactagcccagataattgttaaatggtgcttcttttctgcttctcagtagacttccatgccattacaaaggaaatttgaattacctagtgtttgtatattccatgataactatgtataacttctgttacacagcttatgtattgttaacatttaagtgtaaaccatgccacagctaacacttaaaaatgaaaactaattagttcttgcttagggaaaatgccaggtatgaagtatggcatatacttgacactgtcctgtgtaaccctttactttgctcaggctttcaagattgagtcttttttcccccaaattaggttaacatgcatttgaccccaacctgtggggtttgagtaagctggaaatctgtgacggtaggctttctagtgtcacgaggtggtggtgactgaaggaaaagctgggatcacaggttccttctgatggagaggaaggtttatttctatgcccctcccaccaccctccacctagagctcacccaagcctgctccagtcccaggggcaggccattctgcaaaagcaggacctcacagaaacaagggctgggttgaggtcacccccttcagagttggttcctggccagatgggtaagaggcatttgtaattttaaaaatgtgaaacttgggtttggtgttttcttctaagtgcctaaataagcaagccaggctgttgatattttagccagagaaatcggcaagccaagattaacccgaatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagttgcccaaagggtccccctctaagtaaaacaaatattcagaccacaggctttaatgtaaactgtcaaaaagtgggatgtggaggatttttgttaagtgtcaatcgaagttaaaaagcaagggtttttggccaggcgtggtggctcacgcctgtaatcccagcactttgggaggccgaggccggcaaatcacctaaggtcaggagttcgagaccagcctggccaacatggtgaaaccccgtctctactaaaaatacaaaaaaattagcccggtgtggtggcaagtgcctgtagtcccagctacttgggaggctgaggcaggagaactgcttgaacccgggaggtagaggttgcagtgagccacgatcatgccactgcactccagcctgggcaacagagcaagactccatctcaaaaaagaaaaaaaaaaattaaaggttttggctgggtgcagtggctcatgccggtaatcccagcactttgggaggccaaggtgggaggatcacttgaggtcaggagtttcagactggcctgggcaacgtaaaaaattaaaaaaatagccaggcatggacatggtagtgcatacctgtggtcccagccactcaagaggctgagacaggatgattgcttgagcccaggaggatgaggctgcagtgagccatgatgacgctactgcactccagcctggatgacagggcaagaccctgtctcaatattttaagtcaagggtttgtagtaatgtattcagtgccacttcttgccatcactttgcaattattgaaatgggaatactgagctcagaaagcaaatatgatgctttcatgggagatggagccacatttgtgttctgggtgggatcactagtgcaggagaacattacattttcttctgaaggcaaaatgcttgtaggttttgcctctactttgtatttacttttaaaattgcacttgttcacctaccagtgtttacgaaatcctgtatttgggatgctttttctataataaaatattataatttgagaaaaaaaaaaaaaaaaaaaaaaaaaaaaaaaaaaaaaaaaaaaaaaaaaaanaaaaaaaaaaaaaaaaaaanaaaaagagaggggggggcggcgacgcaaagatatcatcctccgcaaggagagagcgaaccagagatcaggcgcgaccgccacacatatatgaaaggagaaaagagggcgcgccccacgtaggaggaggagtattcttatatatacaacgagagggggggggccggccgctaatataaaacaccacagcccagcgagggggaaaaaccgcggcacacagccgaggacactttggagaggagaagagcaaccccccacaacgggggggggagggcgaacaaagaagaggagagagaaacacccaccctcacccagcagatatattacagagatccagggggagaaaatacaacaacaatctcagagagagggtatgtagagggtggacacaccaaatgtcgatattattggtgcctagcagagaacgaaaaatttggcgacaagacgagttatcttttatcaaaaatatttttacggcggggctcccgctactctaaccggagatacacataaaaaaaaagaagagggaaaaagcaataacgagaggaaggagtaggaggaaaaagaagacaagaaaaaaaaaggagaggagggaaacagcaaaagcaaagagagaagaagaagaaaggaggcaaaaaagcagggagaagagaagagaggagaaaacaaaagagaaagaaacaaaaaaaaaaacaaaagacgacggacacaacagaaaaaaaaaaagcaaaagaaagagaacagaagcagaagaagacgaacaaacaaaacagaaaaaaagaggaacaaaaaaaaaacgaaacaaacaagagcgcaaacaacaag

SEQ ID NO: 357911 - DNA, 2899 bp, Homo sapiens
  misc_feature (2056)..(2056): n is a, c, g, or t
  misc_feature (2076)..(2076): n is a, c, g, or t
ccaggctcaagtgagcctctcacctcagcctcacgagttgctgggaccacagacctctcacttgactatgcctctcagccagcaaatcttcagttccctcacataatgccccttgctgaagacatcaaaggttcttgcttccaaagtgggaataaacggaaccatgaaccttttattgctccagaaagatttggaaacagtagtgtgggctttggcagtaattcccattcccaagcaccagagaaagtgacgcttcttgtagatggcacacgttttgttgtgaatccacagattttcactgctcatccggataccatgctgggaaggatgtttggaccaggaagagagtacaacttcactcggcccaatgagaagggagagtatgagattgctgaaggcatcagtgcaactgtatttcgcacagtgctggattattacaaaaccggtatcatcaattgtcctgatggcatctctatcccagatcttagagatacttgtgattatctctgcattaattttgacttcaacactatccgatgtcaagatctgagtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagtgccacttcttgccatcactttgcaattattgaaatgggaatactgagctcagaaagcaaatatgatgctttcatgggagatggagccacatttgtgttctgggtgggatcactagtgcaggagaacattacattttcttctgaaggcaaaatgcttgtaggttttgcctctactttgtatttacttttaaaattgcacttgttcacctaccagtgtttacgaaatcctgtatttgggatgctttttctataataaaatattataatttgagaaaaaaaaaaaaaaaaaaaaaaaaaaaaaaaaaaaaaaaaaaaaaaaaaaanaaaaaaaaaaaaaaaaaaanaaaaagagaggggggggcggcgacgcaaagatatcatcctccgcaaggagagagcgaaccagagatcaggcgcgaccgccacacatatatgaaaggagaaaagagggcgcgccccacgtaggaggaggagtattcttatatatacaacgagagggggggggccggccgctaatataaaacaccacagcccagcgagggggaaaaaccgcggcacacagccgaggacactttggagaggagaagagcaaccccccacaacgggggggggagggcgaacaaagaagaggagagagaaacacccaccctcacccagcagatatattacagagatccagggggagaaaatacaacaacaatctcagagagagggtatgtagagggtggacacaccaaatgtcgatattattggtgcctagcagagaacgaaaaatttggcgacaagacgagttatcttttatcaaaaatatttttacggcggggctcccgctactctaaccggagatacacataaaaaaaaagaagagggaaaaagcaataacgagaggaaggagtaggaggaaaaagaagacaagaaaaaaaaaggagaggagggaaacagcaaaagcaaagagagaagaagaagaaaggaggcaaaaaagcagggagaagagaagagaggagaaaacaaaagagaaagaaacaaaaaaaaaaacaaaagacgacggacacaacagaaaaaaaaaaagcaaaagaaagagaacagaagcagaagaagacgaacaaacaaaacagaaaaaaagaggaacaaaaaaaaaacgaaacaaacaagagcgcaaacaacaag

SEQ ID NO: 357912 - DNA, 5821 bp, Homo sapiens
  misc_feature (5172)..(5172): n is a, c, g, or t
  misc_feature (5192)..(5192): n is a, c, g, or t
  misc_feature (5212)..(5212): n is a, c, g, or t
ccaggctcaagtgagcctctcacctcagcctcacgagttgctgggaccacagacctctcacttgactatgcctctcagccagcaaatcttcagttccctcacataatgccccttgctgaagacatcaaaggttcttgcttccaaagtgggaataaacggaaccatgaaccttttattgctccagaaagatttggaaacagtagtgtgggctttggcagtaattcccattcccaagcaccagagaaagtgacgcttcttgtagatggcacacgttttgttgtgaatccacagattttcactgctcatccggataccatgctgggaaggatgtttggaccaggaagagagtacaacttcactcggcccaatgagaagggagagtatgagattgctgaaggcatcagtgcaactgtatttcgcacagtgctggattattacaaaaccggtatcatcaattgtcctgatggcatctctatcccagatcttagagatacttgtgattatctctgcattaattttgacttcaacactatccgatgtcaagatctgagtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggctttcaagatgaggacagaaattgcttacaattgctcagtttctcaacagaaagactcataagagtgccagcatggggtacatggagtgaagctgggtgggaagcatcatctgcacagtccctgtcctagtgcaggacttttctctgtatgttttcataccatgggatttttggatatcagtgtattttggttcttgaaatagcctaatagctgctcacacattgggtaggaatattataccaatgtcatccccaaaggaagggtgagctgaatggaaattaagcccagtcattttatttgatctattagctctgttatcagtgcatgatcacccagatcaccctcctcagcccacacagtgctgaaccatcttccctcctgttctccatggctattaatagtatagctaaatttagagtgcagagccagatataagtattttggaattatctcccagtttgtggtagaagctgactggaatacaggttgagtatctcttatccaaaatgctagggaccagaaaggtttcagattttttcagattttggaatacttaacagttgagcaccccaaatctgaaaggcttctgaacgtcatgtcagcactcaaaaaagtggattttggagcacttcaaatttcggatttttggatttgggatgctcatcctgtgtaggagaggctactcgattccatttaatgactgtcctagtcataatcatccaaagataaaagccaggtagatgttgaaagctctttccagggctgaaaaagtgttcttacgttctctgcatgtgactagcatcactgtggaaattaatgctctgttcttcactagaatgtagtaagtggttaaactgagctatcccccacctgatgactattggcatccatttgcaaggccaatggcctggattaagggttaggattatttgtagctagaaggtaattttatttctgtgaaactaattggctcatatttgaggttaggtgtggccttgaccttaccagtacatttatacccactaccagttgactagcccagataattgttaaatggtgcttcttttctgcttctcagtagacttccatgccattacaaaggaaatttgaattacctagtgtttgtatattccatgataactatgtataacttctgttacacagcttatgtattgttaacatttaagtgtaaaccatgccacagctaacacttaaaaatgaaaactaattagttcttgcttagggaaaatgccaggtatgaagtatggcatatacttgacactgtcctgtgtaaccctttactttgctcaggctttcaagattgagtcttttttcccccaaattaggttaacatgcatttgaccccaacctgtggggtttgagtaagctggaaatctgtgacggtaggctttctagtgtcacgaggtggtggtgactgaaggaaaagctgggatcacaggttccttctgatggagaggaaggtttatttctatgcccctcccaccaccctccacctagagctcacccaagcctgctccagtcccaggggcaggccattctgcaaaagcaggacctcacagaaacaagggctgggttgaggtcacccccttcagagttggttcctggccagatgggtaagaggcatttgtaattttaaaaatgtgaaacttgggtttggtgttttcttctaagtgcctaaataagcaagccaggctgttgatattttagccagagaaatcggcaagccaagattaacccgaatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagttgcccaaagggtccccctctaagtaaaacaaatattcagaccacaggctttaatgtaaactgtcaaaaagtgggatgtggaggatttttgttaagtgtcaatcgaagttaaaaagcaagggtttttggccaggcgtggtggctcacgcctgtaatcccagcactttgggaggccgaggccggcaaatcacctaaggtcaggagttcgagaccagcctggccaacatggtgaaaccccgtctctactaaaaatacaaaaaaattagcccggtgtggtggcaagtgcctgtagtcccagctacttgggaggctgaggcaggagaactgcttgaacccgggaggtagaggttgcagtgagccacgatcatgccactgcactccagcctgggcaacagagcaagactccatctcaaaaaagaaaaaaaaaaattaaaggttttggctgggtgcagtggctcatgccggtaatcccagcactttgggaggccaaggtgggaggatcacttgaggtcaggagtttcagactggcctgggcaacgtaaaaaattaaaaaaatagccaggcatggacatggtagtgcatacctgtggtcccagccactcaagaggctgagacaggatgattgcttgagcccaggaggatgaggctgcagtgagccatgatgacgctactgcactccagcctggatgacagggcaagaccctgtctcaatattttaagtcaagggtttgtagtaatgtattcagtgccacttcttgccatcactttgcaattattgaaatgggaatactgagctcagaaagcaaatatgatgctttcatgggagatggagccacatttgtgttctgggtgggatcactagtgcaggagaacattacattttcttctgaaggcaaaatgcttgtaggttttgcctctactttgtatttacttttaaaattgcacttgttcacctaccagtgtttacgaaatcctgtatttgggatgctttttctataataaaatattataatttgagaaaaaaaaaaaaaaaaaaaaaaaaaaaaaaaaaaaaaaaaaaaaaaaaaaanaaaaaaaaaaaaaaaaaaanaaaaaaaaaaaaaaaaaaanaaaaaaaaaaaaaaaaaaaaacaaaacgacaggcgggggcggcggccccccctccccccccgcggcccccgcagaaccacgcatgagggaggaggaacaaagacacgcgcacaaccagaggatagtggaccacttaacaaccacagaagggacgaggcgaagaacaaacacacccgtgacagaggggcccaacacacgagtcgtggcgcggttgacagagggaagacaacacctaccccggcagggccgaataggaagcagcacaaccacacaacgaccatgacacgacagcgaggccagcaaacaacaaaccaaacaacagaacgcgaacgaatggatggtaagcaacgcagacggttacctactcaagcacacacaggaacgcacgaactgacctctagtcgatgatcagatagacttgatcatacaatatacgccgagggtaggcggatcgaacaaccagcgcacagcaccaacacgtcccgccccccgccgtcgcccacatacgcagacaccacacgaacccgcccgaccccccgaacccacgctcgtccgtctcccacaacgccaccacaccaccaccaagcggcgcccacccacaccacccgc

SEQ ID NO: 357913 - DNA, 5694 bp, Homo sapiens
  misc_feature (4851)..(4851): n is a, c, g, or t
  misc_feature (4871)..(4871): n is a, c, g, or t
gaatgctcaaggattattaaacaaagtaacttgaagagtggtagaataggagacataccttaacaaagcttaattatcaccctggagcaggaaacaatctctttgcctttaaatgtgccacttctctgaacctcatcaatgataacagccattccctcatagtctttttcactccagtaatatgtgcatttaggcagaaagcatgttcacctacattttctctctgcaggtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggctttcaagatgaggacagaaattgcttacaattgctcagtttctcaacagaaagactcataagagtgccagcatggggtacatggagtgaagctgggtgggaagcatcatctgcacagtccctgtcctagtgcaggacttttctctgtatgttttcataccatgggatttttggatatcagtgtattttggttcttgaaatagcctaatagctgctcacacattgggtaggaatattataccaatgtcatccccaaaggaagggtgagctgaatggaaattaagcccagtcattttatttgatctattagctctgttatcagtgcatgatcacccagatcaccctcctcagcccacacagtgctgaaccatcttccctcctgttctccatggctattaatagtatagctaaatttagagtgcagagccagatataagtattttggaattatctcccagtttgtggtagaagctgactggaatacaggttgagtatctcttatccaaaatgctagggaccagaaaggtttcagattttttcagattttggaatacttaacagttgagcaccccaaatctgaaaggcttctgaacgtcatgtcagcactcaaaaaagtggattttggagcacttcaaatttcggatttttggatttgggatgctcatcctgtgtaggagaggctactcgattccatttaatgactgtcctagtcataatcatccaaagataaaagccaggtagatgttgaaagctctttccagggctgaaaaagtgttcttacgttctctgcatgtgactagcatcactgtggaaattaatgctctgttcttcactagaatgtagtaagtggttaaactgagctatcccccacctgatgactattggcatccatttgcaaggccaatggcctggattaagggttaggattatttgtagctagaaggtaattttatttctgtgaaactaattggctcatatttgaggttaggtgtggccttgaccttaccagtacatttatacccactaccagttgactagcccagataattgttaaatggtgcttcttttctgcttctcagtagacttccatgccattacaaaggaaatttgaattacctagtgtttgtatattccatgataactatgtataacttctgttacacagcttatgtattgttaacatttaagtgtaaaccatgccacagctaacacttaaaaatgaaaactaattagttcttgcttagggaaaatgccaggtatgaagtatggcatatacttgacactgtcctgtgtaaccctttactttgctcaggctttcaagattgagtcttttttcccccaaattaggttaacatgcatttgaccccaacctgtggggtttgagtaagctggaaatctgtgacggtaggctttctagtgtcacgaggtggtggtgactgaaggaaaagctgggatcacaggttccttctgatggagaggaaggtttatttctatgcccctcccaccaccctccacctagagctcacccaagcctgctccagtcccaggggcaggccattctgcaaaagcaggacctcacagaaacaagggctgggttgaggtcacccccttcagagttggttcctggccagatgggtaagaggcatttgtaattttaaaaatgtgaaacttgggtttggtgttttcttctaagtgcctaaataagcaagccaggctgttgatattttagccagagaaatcggcaagccaagattaacccgaatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagttgcccaaagggtccccctctaagtaaaacaaatattcagaccacaggctttaatgtaaactgtcaaaaagtgggatgtggaggatttttgttaagtgtcaatcgaagttaaaaagcaagggtttttggccaggcgtggtggctcacgcctgtaatcccagcactttgggaggccgaggccggcaaatcacctaaggtcaggagttcgagaccagcctggccaacatggtgaaaccccgtctctactaaaaatacaaaaaaattagcccggtgtggtggcaagtgcctgtagtcccagctacttgggaggctgaggcaggagaactgcttgaacccgggaggtagaggttgcagtgagccacgatcatgccactgcactccagcctgggcaacagagcaagactccatctcaaaaaagaaaaaaaaaaattaaaggttttggctgggtgcagtggctcatgccggtaatcccagcactttgggaggccaaggtgggaggatcacttgaggtcaggagtttcagactggcctgggcaacgtaaaaaattaaaaaaatagccaggcatggacatggtagtgcatacctgtggtcccagccactcaagaggctgagacaggatgattgcttgagcccaggaggatgaggctgcagtgagccatgatgacgctactgcactccagcctggatgacagggcaagaccctgtctcaatattttaagtcaagggtttgtagtaatgtattcagtgccacttcttgccatcactttgcaattattgaaatgggaatactgagctcagaaagcaaatatgatgctttcatgggagatggagccacatttgtgttctgggtgggatcactagtgcaggagaacattacattttcttctgaaggcaaaatgcttgtaggttttgcctctactttgtatttacttttaaaattgcacttgttcacctaccagtgtttacgaaatcctgtatttgggatgctttttctataataaaatattataatttgagaaaaaaaaaaaaaaaaaaaaaaaaaaaaaaaaaaaaaaaaaaaaaaaaaaanaaaaaaaaaaaaaaaaaaanaaaaagagaggggggggcggcgacgcaaagatatcatcctccgcaaggagagagcgaaccagagatcaggcgcgaccgccacacatatatgaaaggagaaaagagggcgcgccccacgtaggaggaggagtattcttatatatacaacgagagggggggggccggccgctaatataaaacaccacagcccagcgagggggaaaaaccgcggcacacagccgaggacactttggagaggagaagagcaaccccccacaacgggggggggagggcgaacaaagaagaggagagagaaacacccaccctcacccagcagatatattacagagatccagggggagaaaatacaacaacaatctcagagagagggtatgtagagggtggacacaccaaatgtcgatattattggtgcctagcagagaacgaaaaatttggcgacaagacgagttatcttttatcaaaaatatttttacggcggggctcccgctactctaaccggagatacacataaaaaaaaagaagagggaaaaagcaataacgagaggaaggagtaggaggaaaaagaagacaagaaaaaaaaaggagaggagggaaacagcaaaagcaaagagagaagaagaagaaaggaggcaaaaaagcagggagaagagaagagaggagaaaacaaaagagaaagaaacaaaaaaaaaaacaaaagacgacggacacaacagaaaaaaaaaaagcaaaagaaagagaacagaagcagaagaagacgaacaaacaaaacagaaaaaaagaggaacaaaaaaaaaacgaaacaaacaagagcgcaaacaacaag

SEQ ID NO: 357914 - DNA, 5962 bp, Homo sapiens
  misc_feature (5119)..(5119): n is a, c, g, or t
  misc_feature (5139)..(5139): n is a, c, g, or t
ccaggctcaagtgagcctctcacctcagcctcacgagttgctgggaccacagacctctcacttgactatgcctctcagccagcaaatcttcagttccctcacataatgccccttgctgaagacatcaaaggttcttgcttccaaagtgggaataaacggaaccatgaaccttttattgctccagaaagatttggaaacagtagtgtgggctttggcagtaattcccattcccaagcaccagagaaagtgacgcttcttgtagatggcacacgttttgttgtgaatccacagattttcactgctcatccggataccatgctgggaaggatgtttggaccaggaagagagtacaacttcactcggcccaatgagaagggagagtatgagattgctgaaggcatcagtgcaactgtatttcgcacagtgctggattattacaaaaccggtatcatcaattgtcctgatggcatctctatcccagatcttagagatacttgtgattatctctgcattaattttgacttcaacactatccgatgtcaagatctgagtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggctttcaagatgaggacagaaattgcttacaattgctcagtttctcaacagaaagactcataagagtgccagcatggggtacatggagtgaagctgggtgggaagcatcatctgcacagtccctgtcctagtgcaggacttttctctgtatgttttcataccatgggatttttggatatcagtgtattttggttcttgaaatagcctaatagctgctcacacattgggtaggaatattataccaatgtcatccccaaaggaagggtgagctgaatggaaattaagcccagtcattttatttgatctattagctctgttatcagtgcatgatcacccagatcaccctcctcagcccacacagtgctgaaccatcttccctcctgttctccatggctattaatagtatagctaaatttagagtgcagagccagatataagtattttggaattatctcccagtttgtggtagaagctgactggaatacaggttgagtatctcttatccaaaatgctagggaccagaaaggtttcagattttttcagattttggaatacttaacagttgagcaccccaaatctgaaaggcttctgaacgtcatgtcagcactcaaaaaagtggattttggagcacttcaaatttcggatttttggatttgggatgctcatcctgtgtaggagaggctactcgattccatttaatgactgtcctagtcataatcatccaaagataaaagccaggtagatgttgaaagctctttccagggctgaatctgttcttcactagaatgtagtaagtggttaaactgagctatcccccacctgatgactattggcatccatttgcaaggccaatggcctggattaagggttaggattatttgtagctagaaggtaattttatttctgtgaaactaattggctcatatttgaggttaggtgtggccttgaccttaccagtacatttatacccactaccagttgactagcccagataattgttaaatggtgcttcttttctgcttctcagtagacttccatgccattacaaaggaaatttgaattacctagtgtttgtatattccatgataactatgtataacttctgttacacagcttatgtattgttaacatttaagtgtaaaccatgccacagctaacacttaaaaatgaaaactaattagttcttgcttagggaaaatgccaggtatgaagtatggcatatacttgacactgtcctgtgtaaccctttactttgctcaggctttcaagattgagtcttttttcccccaaattaggttaacatgcatttgaccccaacctgtggggtttgagtaagctggaaatctgtgacggtaggctttctagtgtcacgaggtggtggtgactgaaggaaaagctgggatcacaggttccttctgatggagaggaaggtttatttctatgcccctcccaccaccctccacctagagctcacccaagcctgctccagtcccaggggcaggccattctgcaaaagcaggacctcacagaaacaagggctgggttgaggtcacccccttcagagttggttcctggccagatgggtaagaggcatttgtaattttaaaaatgtgaaacttgggtttggtgttttcttctaagtgcctaaataagcaagccaggctgttgatattttagccagagaaatcggcaagccaagattaacccgaatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagttgcccaaagggtccccctctaagtaaaacaaatattcagaccacaggctttaatgtaaactgtcaaaaagtgggatgtggaggatttttgttaagtgtcaatcgaagttaaaaagcaagggtttttggccaggcgtggtggctcacgcctgtaatcccagcactttgggaggccgaggccggcaaatcacctaaggtcaggagttcgagaccagcctggccaacatggtgaaaccccgtctctactaaaaatacaaaaaaattagcccggtgtggtggcaagtgcctgtagtcccagctacttgggaggctgaggcaggagaactgcttgaacccgggaggtagaggttgcagtgagccacgatcatgccactgcactccagcctgggcaacagagcaagactccatctcaaaaaagaaaaaaaaaaattaaaggttttggctgggtgcagtggctcatgccggtaatcccagcactttgggaggccaaggtgggaggatcacttgaggtcaggagtttcagactggcctgggcaacgtaaaaaattaaaaaaatagccaggcatggacatggtagtgcatacctgtggtcccagccactcaagaggctgagacaggatgattgcttgagcccaggaggatgaggctgcagtgagccatgatgacgctactgcactccagcctggatgacagggcaagaccctgtctcaatattttaagtcaagggtttgtagtaatgtattcagtgccacttcttgccatcactttgcaattattgaaatgggaatactgagctcagaaagcaaatatgatgctttcatgggagatggagccacatttgtgttctgggtgggatcactagtgcaggagaacattacattttcttctgaaggcaaaatgcttgtaggttttgcctctactttgtatttacttttaaaattgcacttgttcacctaccagtgtttacgaaatcctgtatttgggatgctttttctataataaaatattataatttgagaaaaaaaaaaaaaaaaaaaaaaaaaaaaaaaaaaaaaaaaaaaaaaaaaaanaaaaaaaaaaaaaaaaaaanaaaaagagaggggggggcggcgacgcaaagatatcatcctccgcaaggagagagcgaaccagagatcaggcgcgaccgccacacatatatgaaaggagaaaagagggcgcgccccacgtaggaggaggagtattcttatatatacaacgagagggggggggccggccgctaatataaaacaccacagcccagcgagggggaaaaaccgcggcacacagccgaggacactttggagaggagaagagcaaccccccacaacgggggggggagggcgaacaaagaagaggagagagaaacacccaccctcacccagcagatatattacagagatccagggggagaaaatacaacaacaatctcagagagagggtatgtagagggtggacacaccaaatgtcgatattattggtgcctagcagagaacgaaaaatttggcgacaagacgagttatcttttatcaaaaatatttttacggcggggctcccgctactctaaccggagatacacataaaaaaaaagaagagggaaaaagcaataacgagaggaaggagtaggaggaaaaagaagacaagaaaaaaaaaggagaggagggaaacagcaaaagcaaagagagaagaagaagaaaggaggcaaaaaagcagggagaagagaagagaggagaaaacaaaagagaaagaaacaaaaaaaaaaacaaaagacgacggacacaacagaaaaaaaaaaagcaaaagaaagagaacagaagcagaagaagacgaacaaacaaaacagaaaaaaagaggaacaaaaaaaaaacgaaacaaacaagagcgcaaacaacaag

SEQ ID NO: 357915 - DNA, 807 bp, Homo sapiens
gcggcacagccggtcccggctgcggcttctggctgcgcggcctgcgcgcgcctcccgggcggattccagccccgagcgggacagcgcggcggggagcgacgagatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaagacctctcacttgactatgcctctcagccagcaaatcttcagttccctcacataatgccccttgctgaagacatcaaaggttcttgcttccaaagtgggaataaacggaaccatgaaccttttattgctccagaaagatttggaaacagtagtgtgggctttggcagtaattcccattcccaagcaccagagaaagtgacgcttcttgtagatggcacacgttttgttgtgaatccacagattttcactgctcatccggataccatgctgggaaggatgtttggaccaggaagagagtacaacttcactcggcccaatgagaagggagagtatgagattgctgaaggcatcagtgcaactgtatttcgcacagtgctggtgtgtggtagccttttttgttacattctcttcctcaggggcatgtgtgatcaatagccttgagagttccatcaactatgttattgactttagggtctctggtttccagttgtttcctttct

SEQ ID NO: 357916 - DNA, 1674 bp, Homo sapiens
ggaggcggggctggcggcaggaagctgccctgagcggcgctctgagcggcctgagcccggcggagccctgcagaacccggccgacctccatgggctgcggggggctgcacccggacccctggggcgcggcgcgcccctgaatgcaccgtgggacgcaggagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgtgctctacaccctcaccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttggggacaagagcctccaccctttgctggcaccctttctggaggcccatgtccggctctcctggcgcctgggcctggacaaacgtcaatcagaggctcggctccaagccctgcaggaggcaggccttacccccacaccaccccccagtctcaaagaattgctcatcaaggaggtgctggactaacccttgcctagatttaaggccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccggggggctgtggcacaggttggggcaatgttcccttgttggtgggcccccaagctggcaaggcctcttggctgaaggccagggactctgcccctggagtcctggagttaagggatgaaggcaaggctgcaggtctggcccaggggaattaaaagccagccactcc

SEQ ID NO: 357917 - DNA, 3311 bp, Homo sapiens
ggaggcggggctggcggcaggaagctgccctgagcggcgctctgagcggcctgagcccggcggagccctgcagaacccggccgacctccatgggctgcggggggctgcacccggacccctggggcgcggcgcgcccctgaatgcaccgtgggacgcaggagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgtgctctacaccctcaccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttggggacaagagcctccaccctttgctggcaccctttctggaggcccatgtccggctctcctggcgcctgggcctggacaaacgtcaatcagaggctcggctccaagccctgcaggaggcaggccttacccccacaccaccccccagtctcaaagaattgctcatcaaggaggtgctggactaacccttgcctagatttaaggccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccggggggctgtggcacaggttggggcaatgttcccttgttggtgggcccccaagctggcaaggcctcttggctgaaggccagggactctgcccctggagtcctggagttaagggatgaaggcaaggctgcaggtctggcccaggggaattaaaagccagccactccagtggtatcagtctctttattggatgtgagggccaaaagggactgtaactcctgtctcaggaatggggatagatgggaggttcttgaagccccaggcgaagctggtacctctggctacagcttgctctctgagacctggggcttcactcggatcacgccctcctgggcacaggtcacagctaggactccatcctgacgccacagccgcccatggaccagcccccgagagccacctgtgggtgaggtgaagggtgatgatggcctgcttcagaacagccaaatacacttttttttttttttcctgaaacagagtctcactaagttgccaggctggtctcaagcgcctgggttcaagggatcctcccgcctcagcctcctgagcagctgggattacaggcgcacatcaccatgcccaacctccaagtggacttcttgcaaagggtctggcccagggcagggctgccccacacaagggtgcactgagtgtcgtggctgctccaaatgccccttcatgagcttattatggaccgtcattgaggggtaactcctcccacaggaaccccagttgacagtttaaaagcactttcacacctctcctcgcttcctcaaaaagatcacagagggaggagctctgagaacagtctccttcaacagctcggccaagcagaactgctgtacctctgaccacttgtgttaggaaaactatcggctccctgtataataaatcaagccaggtcctccaagtggtaattcatgaaaaatatccccactaccaccaccaaggggaagaaaggactcagaagagaggacttgaggccatgaggtctggcctcttccctccccatctggagactctttctcccttgctggctttgggcccaagtttgatgtttatgaggatgattgctggtttcccttacacatagcagagctcactcagttctcacagtagccaaatgaagcagttatgtgttgtccagttttccagaccaggactgaaatccagagagggtcaggaatttggccccatgatgaagccaaatctgaacccatgtcctcacttcaaggttatcaatcttggattgtgatgctattggtacttgagaataccccttatctgagtataaagaatccttgagttttgtccttggtttatcaagcaaagcttttcttcatttgaaatgtactcccttggaaaggaggtcagggttctgaagctagacattgatgaacgagtcttgtttctctcccctgcaaggaaggtccaagcaggcccttagggaccactgaatgccccgatcccaatcaggttaatcagaatcacttagagaacttaaaaatacagtttcctggaccttatccaagacctactgagtgagaatcttgagggtggaatcagaatctattttgaaaaggcatccccaaatggcagtctgatggactgcgggtttggataccactgctgtaatgtaaccctctttgtttagatgaggaaactgaggttcagatggaagatatgatttgcctattgtaatacaaagaatctgaactggttttgggactagaactgggtccctgggagaaggtgaatcacatttccagcacattctagaaatttagagcagagcaggtgtccc

SEQ ID NO: 357918 - DNA, 3389 bp, Homo sapiens
ggaggcggggctggcggcaggaagctgccctgagcggcgctctgagcggcctgagcccggcggagccctgcagaacccggccgacctccatgggctgcggggggctgcacccggacccctggggcgcggcgcgcccctgaatgcaccgtgggacgcaggaggtagaggcgcacgaggcggcgcaagagacatcgggagggtcctgagcccctccggggaggaacgcggtcctaggctgaggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgtgctctacaccctcaccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttggggacaagagcctccaccctttgctggcaccctttctggaggcccatgtccggctctcctggcgcctgggcctggacaaacgtcaatcagaggctcggctccaagccctgcaggaggcaggccttacccccacaccaccccccagtctcaaagaattgctcatcaaggaggtgctggactaacccttgcctagatttaaggccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccggggggctgtggcacaggttggggcaatgttcccttgttggtgggcccccaagctggcaaggcctcttggctgaaggccagggactctgcccctggagtcctggagttaagggatgaaggcaaggctgcaggtctggcccaggggaattaaaagccagccactccagtggtatcagtctctttattggatgtgagggccaaaagggactgtaactcctgtctcaggaatggggatagatgggaggttcttgaagccccaggcgaagctggtacctctggctacagcttgctctctgagacctggggcttcactcggatcacgccctcctgggcacaggtcacagctaggactccatcctgacgccacagccgcccatggaccagcccccgagagccacctgtgggtgaggtgaagggtgatgatggcctgcttcagaacagccaaatacacttttttttttttttcctgaaacagagtctcactaagttgccaggctggtctcaagcgcctgggttcaagggatcctcccgcctcagcctcctgagcagctgggattacaggcgcacatcaccatgcccaacctccaagtggacttcttgcaaagggtctggcccagggcagggctgccccacacaagggtgcactgagtgtcgtggctgctccaaatgccccttcatgagcttattatggaccgtcattgaggggtaactcctcccacaggaaccccagttgacagtttaaaagcactttcacacctctcctcgcttcctcaaaaagatcacagagggaggagctctgagaacagtctccttcaacagctcggccaagcagaactgctgtacctctgaccacttgtgttaggaaaactatcggctccctgtataataaatcaagccaggtcctccaagtggtaattcatgaaaaatatccccactaccaccaccaaggggaagaaaggactcagaagagaggacttgaggccatgaggtctggcctcttccctccccatctggagactctttctcccttgctggctttgggcccaagtttgatgtttatgaggatgattgctggtttcccttacacatagcagagctcactcagttctcacagtagccaaatgaagcagttatgtgttgtccagttttccagaccaggactgaaatccagagagggtcaggaatttggccccatgatgaagccaaatctgaacccatgtcctcacttcaaggttatcaatcttggattgtgatgctattggtacttgagaataccccttatctgagtataaagaatccttgagttttgtccttggtttatcaagcaaagcttttcttcatttgaaatgtactcccttggaaaggaggtcagggttctgaagctagacattgatgaacgagtcttgtttctctcccctgcaaggaaggtccaagcaggcccttagggaccactgaatgccccgatcccaatcaggttaatcagaatcacttagagaacttaaaaatacagtttcctggaccttatccaagacctactgagtgagaatcttgagggtggaatcagaatctattttgaaaaggcatccccaaatggcagtctgatggactgcgggtttggataccactgctgtaatgtaaccctctttgtttagatgaggaaactgaggttcagatggaagatatgatttgcctattgtaatacaaagaatctgaactggttttgggactagaactgggtccctgggagaaggtgaatcacatttccagcacattctagaaatttagagcagagcaggtgtccc

SEQ ID NO: 357919 - DNA, 3283 bp, Homo sapiens
  misc_feature (29)..(29): n is a, c, g, or t
  misc_feature (38)..(38): n is a, c, g, or t
  misc_feature (48)..(48): n is a, c, g, or t
tttctttccatgcattttggcgtaactanatgaacagntgggttatanaaagcaggctgtcgccgatccggatcctcgaaccggcgactcatgctggggggctgcccgacctggggcgcgcgcctatcccgggaccaggaggtgcatggctccgctctgacggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgtgctctacaccctcaccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttggggacaagagcctccaccctttgctggcaccctttctggaggcccatgtccggctctcctggcgcctgggcctggacaaacgtcaatcagaggctcggctccaagccctgcaggaggcaggccttacccccacaccaccccccagtctcaaagaattgctcatcaaggaggtgctggactaacccttgcctagatttaaggccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccggggggctgtggcacaggttggggcaatgttcccttgttggtgggcccccaagctggcaaggcctcttggctgaaggccagggactctgcccctggagtcctggagttaagggatgaaggcaaggctgcaggtctggcccaggggaattaaaagccagccactccagtggtatcagtctctttattggatgtgagggccaaaagggactgtaactcctgtctcaggaatggggatagatgggaggttcttgaagccccaggcgaagctggtacctctggctacagcttgctctctgagacctggggcttcactcggatcacgccctcctgggcacaggtcacagctaggactccatcctgacgccacagccgcccatggaccagcccccgagagccacctgtgggtgaggtgaagggtgatgatggcctgcttcagaacagccaaatacacttttttttttttttcctgaaacagagtctcactaagttgccaggctggtctcaagcgcctgggttcaagggatcctcccgcctcagcctcctgagcagctgggattacaggcgcacatcaccatgcccaacctccaagtggacttcttgcaaagggtctggcccagggcagggctgccccacacaagggtgcactgagtgtcgtggctgctccaaatgccccttcatgagcttattatggaccgtcattgaggggtaactcctcccacaggaaccccagttgacagtttaaaagcactttcacacctctcctcgcttcctcaaaaagatcacagagggaggagctctgagaacagtctccttcaacagctcggccaagcagaactgctgtacctctgaccacttgtgttaggaaaactatcggctccctgtataataaatcaagccaggtcctccaagtggtaattcatgaaaaatatccccactaccaccaccaaggggaagaaaggactcagaagagaggacttgaggccatgaggtctggcctcttccctccccatctggagactctttctcccttgctggctttgggcccaagtttgatgtttatgaggatgattgctggtttcccttacacatagcagagctcactcagttctcacagtagccaaatgaagcagttatgtgttgtccagttttccagaccaggactgaaatccagagagggtcaggaatttggccccatgatgaagccaaatctgaacccatgtcctcacttcaaggttatcaatcttggattgtgatgctattggtacttgagaataccccttatctgagtataaagaatccttgagttttgtccttggtttatcaagcaaagcttttcttcatttgaaatgtactcccttggaaaggaggtcagggttctgaagctagacattgatgaacgagtcttgtttctctcccctgcaaggaaggtccaagcaggcccttagggaccactgaatgccccgatcccaatcaggttaatcagaatcacttagagaacttaaaaatacagtttcctggaccttatccaagacctactgagtgagaatcttgagggtggaatcagaatctattttgaaaaggcatccccaaatggcagtctgatggactgcgggtttggataccactgctgtaatgtaaccctctttgtttagatgaggaaactgaggttcagatggaagatatgatttgcctattgtaatacaaagaatctgaactggttttgggactagaactgggtccctgggagaaggtgaatcacatttccagcacattctagaaatttagagcagagcaggtgtccc

SEQ ID NO: 357920 - DNA, 3083 bp, Homo sapiens
gtccggccgaggctgcggccggtgaagctcaggaggtttggatagaatggctgttactacgagggctatgtggctgattgaggagtacaaaaaaaggggcagcagccccgggcactgaagctcatctctgtctttctctcttcttgctgccttgggcctgggtcatttcagacaaacctcaggtaagatgggactgggcttccccgccactgcgcagcagctcccgccctcctgggtgctgtcccaggggtgaaaggaagaggtggggaggtacagctgggagtgtgggggatggggaaggatggggagggaacgggcccgtggacaacttgcatttgccctgacacccaccctccctgtgctctacaccctcaccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttggggacaagagcctccaccctttgctggcaccctttctggaggcccatgtccggctctcctggcgcctgggcctggacaaacgtcaatcagaggctcggctccaagccctgcaggaggcaggccttacccccacaccaccccccagtctcaaagaattgctcatcaaggaggtgctggactaacccttgcctagatttaaggccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccggggggctgtggcacaggttggggcaatgttcccttgttggtgggcccccaagctggcaaggcctcttggctgaaggccagggactctgcccctggagtcctggagttaagggatgaaggcaaggctgcaggtctggcccaggggaattaaaagccagccactccagtggtatcagtctctttattggatgtgagggccaaaagggactgtaactcctgtctcaggaatggggatagatgggaggttcttgaagccccaggcgaagctggtacctctggctacagcttgctctctgagacctggggcttcactcggatcacgccctcctgggcacaggtcacagctaggactccatcctgacgccacagccgcccatggaccagcccccgagagccacctgtgggtgaggtgaagggtgatgatggcctgcttcagaacagccaaatacacttttttttttttttcctgaaacagagtctcactaagttgccaggctggtctcaagcgcctgggttcaagggatcctcccgcctcagcctcctgagcagctgggattacaggcgcacatcaccatgcccaacctccaagtggacttcttgcaaagggtctggcccagggcagggctgccccacacaagggtgcactgagtgtcgtggctgctccaaatgccccttcatgagcttattatggaccgtcattgaggggtaactcctcccacaggaaccccagttgacagtttaaaagcactttcacacctctcctcgcttcctcaaaaagatcacagagggaggagctctgagaacagtctccttcaacagctcggccaagcagaactgctgtacctctgaccacttgtgttaggaaaactatcggctccctgtataataaatcaagccaggtcctccaagtggtaattcatgaaaaatatccccactaccaccaccaaggggaagaaaggactcagaagagaggacttgaggccatgaggtctggcctcttccctccccatctggagactctttctcccttgctggctttgggcccaagtttgatgtttatgaggatgattgctggtttcccttacacatagcagagctcactcagttctcacagtagccaaatgaagcagttatgtgttgtccagttttccagaccaggactgaaatccagagagggtcaggaatttggccccatgatgaagccaaatctgaacccatgtcctcacttcaaggttatcaatcttggattgtgatgctattggtacttgagaataccccttatctgagtataaagaatccttgagttttgtccttggtttatcaagcaaagcttttcttcatttgaaatgtactcccttggaaaggaggtcagggttctgaagctagacattgatgaacgagtcttgtttctctcccctgcaaggaaggtccaagcaggcccttagggaccactgaatgccccgatcccaatcaggttaatcagaatcacttagagaacttaaaaatacagtttcctggaccttatccaagacctactgagtgagaatcttgagggtggaatcagaatctattttgaaaaggcatccccaaatggcagtctgatggactgcgggtttggataccactgctgtaatgtaaccctctttgtttagatgaggaaactgaggttcagatggaagatatgatttgcctattgtaatacaaagaatctgaactggttttgggactagaactgggtccctgggagaaggtgaatcacatttccagcacattctagaaatttagagcagagcaggtgtccc

SEQ ID NO: 357921 - DNA, 1200 bp, Homo sapiens
  misc_feature (1130)..(1130): n is a, c, g, or t
  misc_feature (1132)..(1132): n is a, c, g, or t
ggaggcggggctggcggcaggaagctgccctgagcggcgctctgagcggcctgagcccggcggagccctgcagaacccggccgacctccatgggctgcggggggctgcacccggacccctggggcgcggcgcgcccctgaatgcaccgtgggacgcaggaggtagaggcgcacgaggcggcgcaagagacatcgggagggtcctgagcccctccggggaggaacgcggtcctaggctgaggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgtgctctacaccctcaccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggccggtntngagaagctcttttggggaagcccttgggggctttgggcatgggttgggggcgcaaacagaggcactgg

SEQ ID NO: 357922 - DNA, 1399 bp, Homo sapiens
ggaggcggggctggcggcaggaagctgccctgagcggcgctctgagcggcctgagcccggcggagccctgcagaacccggccgacctccatgggctgcggggggctgcacccggacccctggggcgcggcgcgcccctgaatgcaccgtgggacgcaggagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcaggcgagtgcaggaggacggaggcgggaaccctggggctcgattaggcctccatcccagccgcgttcccagagcatccagggcgctaagttgatccagctgaaactcccacacttcttaaagcgcctgggccacctcttggctgtgtgaccttgagagagtcttaacccccctctgagccaagttttcccttgtgtcaagtgggagaactcactctcatctcagaattgctgcaggcattaaatgtacagggcttgggatccgaatggaaatgatgtattaacgatattttgagggtggagctattaatttagcccctactgtctgccaggcacggtgtttggctcctcggtgcctctctgtccctcagtttccatttctgtaaaaagggggtaagtcctgcctcacactgggaggatgagtgaggccacgtcagtggttgatgtcgaccctggccctaggcccattgatatgactggtcatgtgtctgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgtggtgagtgagggtctagaacccctgggctgtgagtccagaagtatggctaggagcaagtagggaagaccccaacttcctgaggggtctatgtagttataaatggttaccttgtttacaaatggggaaactgaggtcagaaaggggatgtaacttgagcaaatcctcacacaagacttagtttccttgagactgactgaagtggggattaaggaccttcctcttaacctggttttgagactaagagaactggtgtgtgcacttccccacccagcccacaaggtttttgcaaattgtagcaagatgtgagatacagagagaca

SEQ ID NO: 357923 - DNA, 1904 bp, Homo sapiens
  misc_feature (667)..(667): n is a, c, g, or t
ggaggcggggctggcggcaggaagctgccctgagcggcgctctgagcggcctgagcccggcggagccctgcagaacccggccgacctccatgggctgcggggggctgcacccggacccctggggcgcggcgcgcccctgaatgcaccgtgggacgcaggagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgagacagggtcttgccatgttgcccaggctggtctcgaactcctggccttaagctgttctcctgcctcagcctcccaaagnactgggattacagagggggctgtcagaagaactaatgctctatgggaagggagtacaaaaaaaggggcagcagccccgggcactgaagctcatctctgtctttctctcttcttgctgccttgggcctgggtcatttcagacaaacctcagtgctctacaccctcaccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttggggacaagagcctccaccctttgctggcaccctttctggaggcccatgtccggctctcctggcgcctgggcctggacaaacgtcaatcagaggctcggctccaagccctgcaggaggcaggccttacccccacaccaccccccagtctcaaagaattgctcatcaaggaggtgctggactaacccttgcctagatttaaggccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccggggggctgtggcacaggttggggcaatgttcccttgttggtgggcccccaagctggcaaggcctcttggctgaaggccagggactctgcccctggagtcctggagttaagggatgaaggcaaggctgcaggtctggcccaggggaattaaaagccagccactcc

SEQ ID NO: 357924 - DNA, 2058 bp, Homo sapiens
ggaggcggggctggcggcaggaagctgccctgagcggcgctctgagcggcctgagcccggcggagccctgcagaacccggccgacctccatgggctgcggggggctgcacccggacccctggggcgcggcgcgcccctgaatgcaccgtgggacgcaggagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgtgctctacaccctcaccgtgatcggcccaggaccgccagattgccagccagcccagatctctcgccgttactcggactttgagcggctgcaccgaaacctgcagcggcaattccggggcccaatggctgccatctccttcccccagtctcactaagttgccaggctggtctcaagcgcctgggttcaagggatcctcccgcctcagcctcctgagcagctgggattacaggcgcacatcaccatgcccaacctccaagtggacttcttgcaaagggtctggcccagggcagggctgccccacacaagggtgcactgagtgtcgtggctgctccaaatgccccttcatgagcttattatggaccgtcattgaggggtaactcctcccacaggaaccccagttgacagtttaaaagcactttcacacctctcctcgcttcctcaaaaagatcacagagggaggagctctgagaacagtctccttcaacagctcggccaagcagaactgctgtacctctgaccacttgtgttaggaaaactatcggctccctgtataataaatcaagccaggtcctccaagtggtaattcatgaaaaatatccccactaccaccaccaaggggaagaaaggactcagaagagaggacttgaggccatgaggtctggcctcttccctccccatctggagactctttctcccttgctggctttgggcccaagtttgatgtttatgaggatgattgctggtttcccttacacatagcagagctcactcagttctcacagtagccaaatgaagcagttatgtgttgtccagttttccagaccaggactgaaatccagagagggtcaggaatttggccccatgatgaagccaaatctgaacccatgtcctcacttcaaggttatcaatcttggattgtgatgctattggtacttgagaataccccttatctgagtataaagaatccttgagttttgtccttggtttatcaagcaaagcttttcttcatttgaaatgtactcccttggaaaggaggtcagggttctgaagctagacattgatgaacgagtcttgtttctctcccctgcaaggaaggtccaagcaggcccttagggaccactgaatgccccgatcccaatcaggttaatcagaatcacttagagaacttaaaaatacagtttcctggaccttatccaagacctactgagtgagaatcttgagggtggaatcagaatctattttgaaaaggcatccccaaatggcagtctgatggactgcgggtttggataccactgctgtaatgtaaccctctttgtttagatgaggaaactgaggttcagatggaagatatgatttgcctattgtaatacaaagaatctgaactggttttgggactagaactgggtccctgggagaaggtgaatcacatttccagcacattctagaaatttagagcagagcaggtgtccc

SEQ ID NO: 357925 - DNA, 3571 bp, Homo sapiens
ggaggcggggctggcggcaggaagctgccctgagcggcgctctgagcggcctgagcccggcggagccctgcagaacccggccgacctccatgggctgcggggggctgcacccggacccctggggcgcggcgcgcccctgaatgcaccgtgggacgcaggaggtagaggcgcacgaggcggcgcaagagacatcgggagggtcctgagcccctccggggaggaacgcggtcctaggctgagtgggttggggggaaagcgatgctggctgggtcccctggttcgcaagacctcggactgccagggggtggggcctcaccgcgcccctccctctccggttcgggccccgcccctcctcctcctgcgccgggctggggtacccctcctccgggatccggtacacagcgtcgcgcgctccccccagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgtgctctacaccctcaccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttggggacaagagcctccaccctttgctggcaccctttctggaggcccatgtccggctctcctggcgcctgggcctggacaaacgtcaatcagaggctcggctccaagccctgcaggaggcaggccttacccccacaccaccccccagtctcaaagaattgctcatcaaggaggtgctggactaacccttgcctagatttaaggccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccggggggctgtggcacaggttggggcaatgttcccttgttggtgggcccccaagctggcaaggcctcttggctgaaggccagggactctgcccctggagtcctggagttaagggatgaaggcaaggctgcaggtctggcccaggggaattaaaagccagccactccagtggtatcagtctctttattggatgtgagggccaaaagggactgtaactcctgtctcaggaatggggatagatgggaggttcttgaagccccaggcgaagctggtacctctggctacagcttgctctctgagacctggggcttcactcggatcacgccctcctgggcacaggtcacagctaggactccatcctgacgccacagccgcccatggaccagcccccgagagccacctgtgggtgaggtgaagggtgatgatggcctgcttcagaacagccaaatacacttttttttttttttcctgaaacagagtctcactaagttgccaggctggtctcaagcgcctgggttcaagggatcctcccgcctcagcctcctgagcagctgggattacaggcgcacatcaccatgcccaacctccaagtggacttcttgcaaagggtctggcccagggcagggctgccccacacaagggtgcactgagtgtcgtggctgctccaaatgccccttcatgagcttattatggaccgtcattgaggggtaactcctcccacaggaaccccagttgacagtttaaaagcactttcacacctctcctcgcttcctcaaaaagatcacagagggaggagctctgagaacagtctccttcaacagctcggccaagcagaactgctgtacctctgaccacttgtgttaggaaaactatcggctccctgtataataaatcaagccaggtcctccaagtggtaattcatgaaaaatatccccactaccaccaccaaggggaagaaaggactcagaagagaggacttgaggccatgaggtctggcctcttccctccccatctggagactctttctcccttgctggctttgggcccaagtttgatgtttatgaggatgattgctggtttcccttacacatagcagagctcactcagttctcacagtagccaaatgaagcagttatgtgttgtccagttttccagaccaggactgaaatccagagagggtcaggaatttggccccatgatgaagccaaatctgaacccatgtcctcacttcaaggttatcaatcttggattgtgatgctattggtacttgagaataccccttatctgagtataaagaatccttgagttttgtccttggtttatcaagcaaagcttttcttcatttgaaatgtactcccttggaaaggaggtcagggttctgaagctagacattgatgaacgagtcttgtttctctcccctgcaaggaaggtccaagcaggcccttagggaccactgaatgccccgatcccaatcaggttaatcagaatcacttagagaacttaaaaatacagtttcctggaccttatccaagacctactgagtgagaatcttgagggtggaatcagaatctattttgaaaaggcatccccaaatggcagtctgatggactgcgggtttggataccactgctgtaatgtaaccctctttgtttagatgaggaaactgaggttcagatggaagatatgatttgcctattgtaatacaaagaatctgaactggttttgggactagaactgggtccctgggagaaggtgaatcacatttccagcacattctagaaatttagagcagagcaggtgtccc

SEQ ID NO: 357926 - DNA, 3801 bp, Homo sapiens
ggaggcggggctggcggcaggaagctgccctgagcggcgctctgagcggcctgagcccggcggagccctgcagaacccggccgacctccatgggctgcggggggctgcacccggacccctggggcgcggcgcgcccctgaatgcaccgtgggacgcaggagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcaggcgagtgcaggaggacggaggcgggaaccctggggctcgattaggcctccatcccagccgcgttcccagagcatccagggcgctaagttgatccagctgaaactcccacacttcttaaagcgcctgggccacctcttggctgtgtgaccttgagagagtcttaacccccctctgagccaagttttcccttgtgtcaagtgggagaactcactctcatctcagaattgctgcaggcattaaatgtacagggcttgggatccgaatggaaatgatgtattaacgatattttgagggtggagctattaatttagcccctactgtctgccaggcacggtgtttggctcctcggtgcctctctgtccctcagtttccatttctgtaaaaagggggtaagtcctgcctcacactgggaggatgagtgaggccacgtcagtggttgatgtcgaccctggccctaggcccattgatatgactggtcatgtgtctgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgtgctctacaccctcaccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttggggacaagagcctccaccctttgctggcaccctttctggaggcccatgtccggctctcctggcgcctgggcctggacaaacgtcaatcagaggctcggctccaagccctgcaggaggcaggccttacccccacaccaccccccagtctcaaagaattgctcatcaaggaggtgctggactaacccttgcctagatttaaggccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccggggggctgtggcacaggttggggcaatgttcccttgttggtgggcccccaagctggcaaggcctcttggctgaaggccagggactctgcccctggagtcctggagttaagggatgaaggcaaggctgcaggtctggcccaggggaattaaaagccagccactccagtggtatcagtctctttattggatgtgagggccaaaagggactgtaactcctgtctcaggaatggggatagatgggaggttcttgaagccccaggcgaagctggtacctctggctacagcttgctctctgagacctggggcttcactcggatcacgccctcctgggcacaggtcacagctaggactccatcctgacgccacagccgcccatggaccagcccccgagagccacctgtgggtgaggtgaagggtgatgatggcctgcttcagaacagccaaatacacttttttttttttttcctgaaacagagtctcactaagttgccaggctggtctcaagcgcctgggttcaagggatcctcccgcctcagcctcctgagcagctgggattacaggcgcacatcaccatgcccaacctccaagtggacttcttgcaaagggtctggcccagggcagggctgccccacacaagggtgcactgagtgtcgtggctgctccaaatgccccttcatgagcttattatggaccgtcattgaggggtaactcctcccacaggaaccccagttgacagtttaaaagcactttcacacctctcctcgcttcctcaaaaagatcacagagggaggagctctgagaacagtctccttcaacagctcggccaagcagaactgctgtacctctgaccacttgtgttaggaaaactatcggctccctgtataataaatcaagccaggtcctccaagtggtaattcatgaaaaatatccccactaccaccaccaaggggaagaaaggactcagaagagaggacttgaggccatgaggtctggcctcttccctccccatctggagactctttctcccttgctggctttgggcccaagtttgatgtttatgaggatgattgctggtttcccttacacatagcagagctcactcagttctcacagtagccaaatgaagcagttatgtgttgtccagttttccagaccaggactgaaatccagagagggtcaggaatttggccccatgatgaagccaaatctgaacccatgtcctcacttcaaggttatcaatcttggattgtgatgctattggtacttgagaataccccttatctgagtataaagaatccttgagttttgtccttggtttatcaagcaaagcttttcttcatttgaaatgtactcccttggaaaggaggtcagggttctgaagctagacattgatgaacgagtcttgtttctctcccctgcaaggaaggtccaagcaggcccttagggaccactgaatgccccgatcccaatcaggttaatcagaatcacttagagaacttaaaaatacagtttcctggaccttatccaagacctactgagtgagaatcttgagggtggaatcagaatctattttgaaaaggcatccccaaatggcagtctgatggactgcgggtttggataccactgctgtaatgtaaccctctttgtttagatgaggaaactgaggttcagatggaagatatgatttgcctattgtaatacaaagaatctgaactggttttgggactagaactgggtccctgggagaaggtgaatcacatttccagcacattctagaaatttagagcagagcaggtgtccc

SEQ ID NO: 357927 - DNA, 1122 bp, Homo sapiens
  misc_feature (1052)..(1052): n is a, c, g, or t
  misc_feature (1054)..(1054): n is a, c, g, or t
ggaggcggggctggcggcaggaagctgccctgagcggcgctctgagcggcctgagcccggcggagccctgcagaacccggccgacctccatgggctgcggggggctgcacccggacccctggggcgcggcgcgcccctgaatgcaccgtgggacgcaggagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgtgctctacaccctcaccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggccggtntngagaagctcttttggggaagcccttgggggctttgggcatgggttgggggcgcaaacagaggcactgg

SEQ ID NO: 357928 - DNA, 1095 bp, Homo sapiens
accgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgttggggccactcattggggtccaggtgcccgaggagaaggtggaacgcaacaggactgccatggaccaggccctgcaatggctggaggacaagttcctgggggacaggcccttcctcgctggccagcaggtgacactggctgatctcatggccctggaggagctgatgcagccggtggctctcggctacgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaa

SEQ ID NO: 357929 - DNA, 1276 bp, Homo sapiens
accgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaagggatggaaagaaaatactgaatggagttgacagagttcttgcgtggaatgcacgcatataaattcacaaagcccagaagacctcgggaagaaggacatactgttggcagcacaagagcaaggagttcttgcagatcaacagcctggggaaactgccgacgctcaaggatggtgatttcatcttgaccgaaagggcggctgctggcatatcacagagatgaggttctcaaaatgcaaagcagaaggtccagccaagagtcggtgcccaagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgttggggccactcattggggtccaggtgcccgaggagaaggtggaacgcaacaggactgccatggaccaggccctgcaatggctggaggacaagttcctgggggacaggcccttcctcgctggccagcaggtgacactggctgatctcatggccctggaggagctgatgcagccggtggctctcggctacgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaa

SEQ ID NO: 357930 - DNA, 1197 bp, Homo sapiens
accgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaaggctaacaggagtgtctacctcacagggcggctgctggcatatcacagagatgaggttctcaaaatgcaaagcagaaggtccagccaagagtcggtgcccaagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgttggggccactcattggggtccaggtgcccgaggagaaggtggaacgcaacaggactgccatggaccaggccctgcaatggctggaggacaagttcctgggggacaggcccttcctcgctggccagcaggtgacactggctgatctcatggccctggaggagctgatgcagccggtggctctcggctacgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaa

SEQ ID NO: 357931 - DNA, 1490 bp, Homo sapiens
accgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgttggggccactcattggggtccaggtgcccgaggagaaggtggaacgcaacaggactgccatggaccaggccctgcaatggctggaggacaagttcctgggggacaggcccttcctcgctggccagcaggtgacactggctgatctcatggccctggaggagctgatgcagccggtggctctcggctacgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaaaaaaaaaaaaaaaaaaacacaaacaaaaaacaaaaaataaactaacaaaaaaaaaaataaaataaacaatacataaaaacaaatgtcccaatcaataaatatgagaatgtataattaacatttcctgcactgtgtgtataattatcgggggagaacaagcaacaaaatggaatttacttaaccaacaacaacaataatgatcatacaaacaacaagacaccaacatgaattctggagacaagacagatttaaatccaggtcacaatttacttgtgtgtgacccttgggcaagctactcctaagtcttagttctcgaacgataatcatatctattctcacaggattaaataagatagtatacagaattgccagtcaggtaatagacactattatg

SEQ ID NO: 357932 - DNA, 1043 bp, Homo sapiens
accgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgttggggccactcattggggtccaggtgcccgaggagaaggtggaacgcaacaggactgccatggaccaggccctgcaatggctggaggacaagttcctgggggacaggcccttcctcgctggccagcaggtgacactggctgatctcatggccctggaggagctgatgcagccggtggctctcggctacgaactgtttgagggacggccacgactggcagcatggcgtggacgagtggaggctttcctgggtgctgagctatgccaggaggcccacagcatcatcttgagcatcctggaacaggcggccaagaagccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaa

SEQ ID NO: 357933 - DNA, 534 bp, Homo sapiens
accgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaaccctgtctctactaaaaatggaaaaaaaagttaaccgggcgtggtggcg

SEQ ID NO: 357934 - DNA, 548 bp, Homo sapiens
  misc_feature (129)..(129): n is a, c, g, or t
  misc_feature (159)..(160): n is a, c, g, or t
atcccccccctttggggggggggggttttgggcctctttggtaaaaaaaagacctttaaaattggggcccccccccaagggggggaaaaggggggcccccccaaaccaaagggccaatttcccaattantcctctggggaagggcccaaaattcccccnnccttggaaacccaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaa

SEQ ID NO: 357935 - DNA, 1204 bp, Homo sapiens
accgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaagggcggctgctggcatatcacagagatgaggttctcaaaatgcaaagcagaaggtccagccaagagtcggtgcccaaggcaacaaagacaggaggagactcgtaggaggactcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgttggggccactcattggggtccaggtgcccgaggagaaggtggaacgcaacaggactgccatggaccaggccctgcaatggctggaggacaagttcctgggggacaggcccttcctcgctggccagcaggtgacactggctgatctcatggccctggaggagctgatgcagccggtggctctcggctacgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaa

SEQ ID NO: 357936 - DNA, 458 bp, Homo sapiens
agcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaccaagagttattggttttactacattgttgtgttatacatatggagtaaaagtatg

SEQ ID NO: 357937 - DNA, 1660 bp, Homo sapiens
actggcgggcgggatccctccgctctggggaggcagcgctggcggcggggctggggccactgaggaaatccatccgcgccgccgccgccgccgccgccgccgccgccgcctccgccgcggaggaagacagcgccgcccgcgcaccgccagcgacccccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgt

SEQ ID NO: 357938 - DNA, 330 bp, Homo sapiens
actggcgggcgggatccctccgctctggggaggcagcgctggcggcggggctggggccactgaggaaatccatccgcgccgccgccgccgccgccgccgccgccgccgcctccgccgcggaggaagacagcgccgcccgcgcaccgccagcgacccccgccgcagagtcccaccgccacaggcctcgggccagcggccaggagctgcctccccagggcggcgggcgcggtgcggaattggccacgcaggcgccgcaagaataaggacctgttatagttaccgggggtgcgactgaggagaggaagcagctgtagggagagaaggaggaat

SEQ ID NO: 357939 - DNA, 1718 bp, Homo sapiens
  misc_feature (1367)..(1367): n is a, c, g, or t
  misc_feature (1378)..(1378): n is a, c, g, or t
  misc_feature (1383)..(1384): n is a, c, g, or t
  misc_feature (1401)..(1401): n is a, c, g, or t
  misc_feature (1403)..(1403): n is a, c, g, or t
  misc_feature (1416)..(1416): n is a, c, g, or t
  misc_feature (1418)..(1418): n is a, c, g, or t
  misc_feature (1438)..(1438): n is a, c, g, or t
  misc_feature (1446)..(1446): n is a, c, g, or t
  misc_feature (1458)..(1459): n is a, c, g, or t
  misc_feature (1466)..(1466): n is a, c, g, or t
actggcgggcgggatccctccgctctggggaggcagcgctggcggcggggctggggccactgaggaaatccatccgcgccgccgccgccgccgccgccgccgccgccgcctccgccgcggaggaagacagcgccgcccgcgcaccgccagcgacccccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggtggtatcccctagagctggtgatgccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccacctcnccccaccccanccacnnccccccccccacccccncnccacaccccagcncncccccccccccccaaccccncccccccncccccccccccnnccccccncctccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgt

SEQ ID NO: 357940 - DNA, 317 bp, Homo sapiens
cgccgccgcctccgccgcggaggaagacagcgccgcccgcgcaccgccagcgacccccgccgcagagtcccaccgccacaggtaccttcgctggcaaaaggagtcctctcgccccccagccccaatttcccccaggggaacctctcttccttcggtctcccggggctggcctcctgggagcggacgtaactccccagacctccgctcccttcccctcttgcccggtcgctcccaaacccggaaggggaactggggaaccctcgccccccaccgtgcgtgcgcttccccgcaccatcagcgaagtttttgcccgaccc

SEQ ID NO: 357941 - DNA, 1663 bp, Homo sapiens
  misc_feature (1312)..(1312): n is a, c, g, or t
  misc_feature (1323)..(1323): n is a, c, g, or t
  misc_feature (1328)..(1329): n is a, c, g, or t
  misc_feature (1346)..(1346): n is a, c, g, or t
  misc_feature (1348)..(1348): n is a, c, g, or t
  misc_feature (1361)..(1361): n is a, c, g, or t
  misc_feature (1363)..(1363): n is a, c, g, or t
  misc_feature (1383)..(1383): n is a, c, g, or t
  misc_feature (1391)..(1391): n is a, c, g, or t
  misc_feature (1403)..(1404): n is a, c, g, or t
  misc_feature (1411)..(1411): n is a, c, g, or t
actggcgggcgggatccctccgctctggggaggcagcgctggcggcggggctggggccactgaggaaatccatccgcgccgccgccgccgccgccgccgccgccgccgcctccgccgcggaggaagacagcgccgcccgcgcaccgccagcgacccccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccacctcnccccaccccanccacnnccccccccccacccccncnccacaccccagcncncccccccccccccaaccccncccccccncccccccccccnnccccccncctccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgt

SEQ ID NO: 357942 - DNA, 1067 bp, Homo sapiens
  misc_feature (1020)..(1020): n is a, c, g, or t
  misc_feature (1043)..(1043): n is a, c, g, or t
actggcgggcgggatccctccgctctggggaggcagcgctggcggcggggctggggccactgaggaaatccatccgcgccgccgccgccgccgccgccgccgccgccgcctccgccgcggaggaagacagcgccgcccgcgcaccgccagcgacccccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccaattgaaatcccgaacatcaaatgccaagttggctttccttcccccaacgggctaacgcccttcaaccaaccgggcntcctgaaccgaacgccaacgttntcccgccctcctttccgaacccct

SEQ ID NO: 357943 - DNA, 788 bp, Homo sapiens
actggcgggcgggatccctccgctctggggaggcagcgctggcggcggggctggggccactgaggaaatccatccgcgccgccgccgccgccgccgccgccgccgccgcctccgccgcggaggaagacagcgccgcccgcgcaccgccagcgacccccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtttccgcttcctggatgacaccaaatcaccagctctgggtcagatgtgccgggatcctctagatcaccgcagcacca

SEQ ID NO: 357944 - DNA, 417 bp, Homo sapiens
tctctgcatgaccctgttacttttctaagacttagttccctaatttttaaaagggtggtaatattatatctacattgtagaagtaagtgtaaacaggaaatattggttagctctttagaacagtatctggcactttgaacacacttaacaactgttagctattgttaaagctgctactattattaatgttaaattatataggattagttcatatccccctattatacccctctttatgtcaaaagcttttactgacactgaaatgagctgggtgaacttagaattgctgatagttgctgatagttacattattgtatatgtgtagaaggaaccggaagacctgggcttttattctgatcccttcgcttttcaactgtgttaccttgcacacgtttcttcacatctctgaacttcatt

SEQ ID NO: 357945 - DNA, 244 bp, Homo sapiens
gtaccaccacgcccagctaattattgtaatttttttagagcgggggttttgtcatattggccaggctagtctcaaactcctggcctcatgtgatccaccgtcggcctactaaagtgctgggattacaggcaatgagccactgtgcctggccaaaaattccgttttctgattgttgctggtacatggtcacattattggttttacatattgatcttacactcagcaactcttttttgaactcttt

SEQ ID NO: 357946 - DNA, 2424 bp, Homo sapiens
tgctttatagcgtgcaaacctcgccgcgccagggccaagggacaggttggagctgttgatctgttgcgcaattgctattttccccagagcggctttgtctttggatttagcgtttcagaattgcaattccaaaatgtgtaagacgggatattctcttctgtgctgtcaagggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 357947 - DNA, 2666 bp, Homo sapiens
agttttttaagcacaatagcaaaaccatcagctctgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtggtggctttagtgaatataatggtaaactttagaggacgctaaagcctccttttatagcgctcctcaacggtagggagagctgaagggaaaacattctgactgtgtggcagggtgattttcttccttatgaccacttacagtggatatttattgtcaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 357948 - DNA, 2472 bp, Homo sapiens
agcggaggggccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccgtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 357949 - DNA, 3403 bp, Homo sapiens
agttttttaagcacaatagcaaaaccatcagctctgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtggtggctttagtgaatataatggtaaactttagaggacgctaaagcctccttttatagcgctcctcaacggtagggagagctgaagggaaaacattctgactgtgtggcagggtgattttcttccttatgaccacttacagtggatatttattgtcaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtgaggtataaaataacctggttaatagaaaaactccatcataactataaaataacaatctattctatgtaagtcccgtcaatgaatctccatttaaaagaataaaaacatttttaggaggaaattttttaaccaaggaaatactcttgtcaaggaaaccttagcctataaataactttacaattaagaaaaaaaaaaacccttcacacaatacaaaaccaaaaccattgactattgcatagccagaaacatggacagcataaccatggaaacaaataacccatttgctgcaagtatctaagaggtttggtgagtaaagagccagctgggcaataaacgaagacttgttcagttaacaattttaataaatctgttttatctagtaccactgtgctagatattatataaactaaatcctaaagattgtacttacgcattttaaagtttactttcaaatgcttaagctgaaacagaccagcaaattataaatttgagtcagtggggtaggaaaaaaagatttgttatttacaaacggggtcatgactggttagtaagtagagagacacagaactgcagctgattccattttgttttgtagtggtgccttagagcttactcatcccctgttggtggaagactcataaatcaatgccttatcaattttaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 357950 - DNA, 2548 bp, Homo sapiens
agcggaggggccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtataaacttccttctcatgcagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 357951 - DNA, 3090 bp, Homo sapiens
tgctttatagcgtgcaaacctcgccgcgccagggccaagggacaggttggagctgttgatctgttgcgcaattgctattttccccagagcggctttgtctttggatttagcgtttcagaattgcaattccaaaatgtgtaagacgggatattctcttctgtgctgtcaagggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtgaggtataaaataacctggttaatagaaaaactccatcataactataaaataacaatctattctatgtaagtcccgtcaatgaatctccatttaaaagaataaaaacatttttaggaggaaattttttaaccaaggaaatactcttgtcaaggaaaccttagcctataaataactttacaattaagaaaaaaaaaaacccttcacacaatacaaaaccaaaaccattgactattgcatagccagaaacatggacagcataaccatggaaacaaataacccatttgctgcaagtatctaagaggtttggtgagtaaagagccagctgggcaataaacgaagacttgttcagttaacaattttaataaatctgttttatctagtaccactgtgctagatattatataaactaaatcctaaagattgtacttacgcattttaaagtttactttcaaatgcttaagctgaaacagaccagcaaattataaatttgagtcagtggggtaggaaaaaaagatttgttatttacaaacggggtcatgactggttagtaagtagagagacacagaactgcagctgattccattttgttttgtagtggtgccttagagcttactcatcccctgttggtggaagactcataaatcaatgccttatcaattttaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 357952 - DNA, 2436 bp, Homo sapiens
agcggaggggccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 357953 - DNA, 1773 bp, Homo sapiens
agcggaggggccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcaga

SEQ ID NO: 357954 - DNA, 1331 bp, Homo sapiens
agcggaggggccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaacacccttaaagcccagagaattccagagttctgagtccgggttttccgtttaacaagtccccggggtttccccaaaaccccggggatctcccgttggggaacctattgggc

SEQ ID NO: 357955 - DNA, 653 bp, Homo sapiens
ttaaattgtttagctctggcaaaaaaaaaaaattttaagagctggtactaataaaggattattatgactgttaaattataaattatttgtttgggattcctttgagtttattcacacagtattttccataagataatcatccatttaatttagatgttttgcattttcagaatgttttatttgaaaatataaaaataattttatactacatttctagtaccagggttacagagaaataaagtatatcaagaggatactttgcctcttcaatagcaggtacatctaaacccaagaaaatgttacacactgacatgaaagcactgattcatttatttccatcagtagacatacgcccactataccctaggcagagtttgaagtagaaaggacaaaaccaatatccctgcctggcctggaacttgcattctagcgaaggggaggtaacaagcatactccactatgttagaaggaactggacggggaaaaccagtaaaaagcgtcacaacttaaggctgtaaatgggaagagccttactgaagtggcaacatttgaaggtgtgggagaagctgttctcatagccaagaacactgcagacaagacacagcaggtccaaaggctgaaccacatttgagaaaaaacaaggacaatgtggc

SEQ ID NO: 357956 - DNA, 2526 bp, Homo sapiens
agcggaggggccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 357957 - DNA, 968 bp, Homo sapiens
agcggaggggccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacaggctctcactatgttgcccaggctcgtctcaaattcctggacttgggatccatctgcctcagcctcccaaagtgctgggattacaggcgtgagccactgtgcctggccctggtaacttttaatgttcctttgaaggtgttttcctag

SEQ ID NO: 357958 - DNA, 2737 bp, Homo sapiens
agttttttaagcacaatagcaaaaccatcagctctgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtggtggctttagtgaatataatggtaaactttagaggacgctaaagcctccttttatagcgctcctcaacggtagggagagctgaagggaaaacattctgactgtgtggcagggtgattttcttccttatgaccacttacagtggatatttattgtcaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 357959 - DNA, 2778 bp, Homo sapiens
gtgtaggaaagatggaaagaatggtgatatttcacaactgctagattgacactttaacttgagagttatccctctataaactggatatttgctgagcaaagtttaaagaaaactccatgtattcagtaatgttttccagaccccacttctcttatataagccagtggcttagagtgcttgctctaatttctatattccattaaacaagggtgggatttcttctcattcaaaccatttgtgactttgccctttagtgacctctaccatcaccctatcattaatgatccaagtgattagaatggatggctatgtgtttgtaggttgtttgttgtctttaatgaatagattcattgaatggaattaactgtgctcttctagaacattggatctgtgttctcatttagattgtatttgtaatctccccacttcccaccatcaacagtggcataatgtgaattaatttatgtggtatctgtcatttaaaaaacatgagctctctccttcctttttttgtcttaaacataggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 357960 - DNA, 2469 bp, Homo sapiens
agcggaggggccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggca

SEQ ID NO: 357961 - DNA, 2353 bp, Homo sapiens
tgctttatagcgtgcaaacctcgccgcgccagggccaagggacaggttggagctgttgatctgttgcgcaattgctattttccccagagcggctttgtctttggatttagcgtttcagaattgcaattccaaaatgtgtaagacgggatattctcttctgtgctgtcaagggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 357962 - DNA, 2472 bp, Homo sapiens
agcggaggggccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaacctaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 357963 - DNA, 3007 bp, Homo sapiens
agcggaggggccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaattaaaaaaaaaaacagaaaaaaacaaaaaaacaaaaagcaacaaaacaaaacacaaaacaaagaacagaacacaacaaagaacacacagacagacgaaaaagcaaaaccgacacgaaaaaacaaacacacacaagaaacacaccagcgcatcggaccggctacaaacatagaccagacgaagacgagacaaaagcaggccagcgaaacgacagagaagaacaacacaacgagagtaaaacataaaatgaggacagcacacaccccgcaaagccatcacgacagcgacgaacgcataaagacgcaaaaacgaaacgagacggataacagagaaaacacgagaggaagccaggagccaataatcagaggagataagaaccgacgatggaagagagagacgaagaacacacaaaaagagggagaggagaggaagggcgagacgaacaggagagagggcggcaaagcaacacaaagaggaagaggaca

SEQ ID NO: 357964 - DNA, 1969 bp, Homo sapiens
agcggaggggccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtttcagtcacttgttccctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttcagtgtcttaatattgaaaatgacaagccggttgagaccccgtcgacgcggccgcgaattta

SEQ ID NO: 357965 - DNA, 904 bp, Homo sapiens
agttttttaagcacaatagcaaaaccatcagctctgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtggtggctttagtgaatataatggtaaactttagaggacgctaaagcctccttttatagcgctcctcaacggtagggagagctgaagggaaaacattctgactgtgtggcagggtgattttcttccttatgaccacttacagtggatatttattgtcaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccagtgcccacattcccaatgaagagctagactttacaaagaaagatcaagtacaaaagtgaaagaatgggtgggatgtcatagctggggcatatatgctgatgacccaaattatgtggtaacccttcctttccaggctgacctgatacccaagtgt

SEQ ID NO: 357966 - DNA, 437 bp, Homo sapiens
gagataagatcagtttagttgctaatgaattttggtccccagcacagaacaattacaatggaatatgaggacggtttcaagagcatcaggaagattttaccaaattctatttaatctcctctcaccctgtttacaggtcagcttattaaagttgaaaattcctggtagatggtttccatggagagagaaaattatctctttagataaactattctagggttaatttgattcaaccaacatttatttagagtttcacatgtgaaacacaatactgtcttaggagctacagggatactaagatgaacgtggaaaaaaatgattgcccttaattaagttggcatgaagttcatgtacacaaagatgtacacggatctaggataaaatgtggcaagtactatcatgtaagtataaataaataaaaaattgtactcttcata

SEQ ID NO: 357967 - DNA, 2634 bp, Homo sapiens
  misc_feature (110)..(110): n is a, c, g, or t
ggcttctgtactgcgcgcgcacatgcgcgcaaacccggaagcggattatgtggagtgaaagttacaccgtggcggaatggggtgtattgattctgagcaataaacaacanatttttaacattcaggattgacttctaaggactcttggtacatgaggaagaaacccggaaggggaagaggaaagcaaaggcgtcaggaatggttcttcctcaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatggtagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtaatgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggatttttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgta

SEQ ID NO: 357968 - DNA, 2581 bp, Homo sapiens
  misc_feature (1)..(1): n is a, c, g, or t
nggtgcagtggctcacgcctgtaatcccagcactctgggaggctgatgagggcagatcacaaggtcaggagatcaagaccatcctggtgaacacggtggggccctgtctctactgaaaatacaaaaaaaaatcagccctcagaagttgctggaattacaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatggtagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtaatgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggatttttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgta

SEQ ID NO: 357969 - DNA, 866 bp, Homo sapiens
ggggcccgccgaggcctggcttctgtcctgcgcgcgcagattctcgcaaatctggaagcggatcgcgtggagtgacggtcacaccgcggcgaattaatttccaaagactcatgttacatgagaaagccaccaagaagaccaaagaaaaggagacaaggatggctcttcctcagggatgcttgactttcaaggatgtggctatagaattctctttggaggagtggaaatgcctgaaccctgcacagagggctttatacagggccgtgatgttggagaactacaggaacctggagtctgtgggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctgggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatggtctccctctgatgccgagccgaagctggacggtactgctgccatcttggctcactgcaacctccctgcctgattctcctgcctcagcctgctgagtgcctgtgattgcaggcgcgcgccgccacgcctgactggttttcgtatttttttggtggagacggggattcgctgtgttggccgggctggtctccagctcctaaccgggagtga

SEQ ID NO: 357970 - DNA, 724 bp, Homo sapiens
ggggcccgccgaggcctggcttctgtcctgcgcgcgcagattctcgcaaatctggaagcggatcgcgtggagtgacggtcacaccgcggcgaattaatttccaaagactcatgttacatgagaaagccaccaagaagaccaaagaaaaggagacaaggatggctcttcctcagggatgcttgactttcaaggatgtggctatagaattctctttggaggagtggaaatgcctgaaccctgcacagagggctttatacagggccgtgatgttggagaactacaggaacctggagtctgtgggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctggaattttttctaaatgcgagaccacagaaataccaccaaaacaggagaggcatacccggagaccattccacacagtaaccgcgcaaagcctcgaacccacgacatacaaaactttcgcttcacggacacaccacacgtccatgaccttctactcgcctgggccatgaatcgaagaccttacttagccacgtccgcccgacctcatcggcg

SEQ ID NO: 357971 - DNA, 2509 bp, Homo sapiens
ggcttctgtactgcgcgcgcacatgcgcgcaaacccggaagcggattatgtggagtgaaagttacaccgtggcggattgacttctaaggactcttggtacatgaggaagaaacccggaaggggaagaggaaagcaaaggcgtcaggaatggttcttcctcaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatggtagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtaatgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtattgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggatttttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgta

SEQ ID NO: 357972 - DNA, 2870 bp, Homo sapiens
ggcttctgtactgcgcgcgcacatgcgcgcaaacccggaagcggattatgtggagtgaaagttacaccgtggcggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctggatgttctgcgttcttcatgatagctcagtgggggttccagaagtaaagaaggcttaaaaccttatggctggcaaggcgtggtgactcatgcctgtaatcccagcactttgggaggccaaagcttgtggatcacttcagtggagtgcagtggcacaatctcggctcaccaccacctccgcctcccgggttcaagcgattctcccgcctcagcctcagaagttgctggaattacaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatggtagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtaatgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtattgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggatttttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgta

SEQ ID NO: 357973 - DNA, 2596 bp, Homo sapiens
atcgagacagtctcactctagcctgggagacagccaggctccatctcaaaaaaaaaaaaacacaaaaattatccaggcgtgatggcacatgtctgtaatcccaggtactagaaaggctaaggtaagattatcacctgaacctgggaggcaatgtggagtgcagtggcacaatctcggctcaccaccacctccgcctcccgggttcaagcgattctcccgcctcagcctcagaagttgctggaattacaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatggtagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtaatgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtattgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggatttttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgta

SEQ ID NO: 357974 - DNA, 3302 bp, Homo sapiens
ggcttctgtactgcgcgcgcacatgcgcgcaaacccggaagcggattatgtggagtgaaagttacaccgtggcggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctggatgttctgcgttcttcatgatagctcagtgggggttccagaagtaaagaaggcttaaaaccttatggctggcaaggcgtggtgactcatgcctgtaatcccagcactttgggaggccaaagcttgtggatcacttcagtggagtgcagtggcacaatctcggctcaccaccacctccgcctcccgggttcaagcgattctcccgcctcagcctcagaagttgctggaattacaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatggtagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtaatgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggatttttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgtaaaaaaaaaaaaggttactaatctaagatgcatcctcagggttcattaaaaattcatagtggagggccggacccagtgactcatgcctgtaatcccagaactttgggagaccgaggcaggtggatcatgaagtcaagagattgagaccatcctagccaaccaacatggtgaaatcccgtctctactaaaaattcaaaaattagctgggggtggtggcacacgcctgtagtccacactgcttgggagaccgaggcaggagagtcacttgaacccggcaggcagaggttgcagtgagccgagatcacaccactgcactccagcctggtcgacagagcgagattctgtctcaaaaaaaaaaa

SEQ ID NO: 357975 - DNA, 2777 bp, Homo sapiens
ggcttctgtactgcgcgcgcacatgcgcgcaaacccggaagcggattatgtggagtgaaagttacaccgtggcggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctggatgttctgcgttcttcatgatagctcagtgggggttccagaagtaaagaaggcttaaaaccttatggctggcaaggcgtggtgactcatgcctgtaatcccagcactttgggaggccaaagcttgtggatcacttcagtggagtgcagtggcacaatctcggctcaccaccacctccgcctcccgggttcaagcgattctcccgcctcagcctcagaagttgctggaattacaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatggtagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtaatgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtattgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggatttttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgta

SEQ ID NO: 357976 - DNA, 1216 bp, Homo sapiens
ctctctctctctcttttctgactctctgtctctttctccctctctactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggatttttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgta

SEQ ID NO: 357977 - DNA, 1794 bp, Homo sapiens
ggcttctgtactgcgcgcgcacatgcgcgcaaacccggaagcggattatgtggagtgaaagttacaccgtggcggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctggatgttctgcgttcttcatgatagctcagtgggggttccagaagtaaagaaggcttaaaaccttatggctggcaaggcgtggtgactcatgcctgtaatcccagcactttgggaggccaaagcttgtggatcacttcagtggagtgcagtggcacaatctcggctcaccaccacctccgcctcccgggttcaagcgattctcccgcctcagcctcagaagttgctggaattacaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatggtagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtaatgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaacatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgta

SEQ ID NO: 357978 - DNA, 2515 bp, Homo sapiens
  misc_feature (1)..(1): n is a, c, g, or t
nggtgcagtggctcacgcctgtaatcccagcactctgggaggctgatgagggcagatcacaaggtcaggagatcaagaccatcctggtgaacacggtggggccctgtctctactgaaaatacaaaaaaaaatcagctcagaagttgctggaattaaccgggttattttttccttaattgtggtggagactcagggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatggtagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtaatgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtattgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggatttttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgta

SEQ ID NO: 357979 - DNA, 305 bp, Homo sapiens
ttgtcttcagctgatcgccatacattgctctctgcctaagaactggaggctttgcaggacttggggaggccaaggagggcagatcacctgaggtcaggagttcaagaccagcctggccaaaatggtgaaaccccacctctactaaaaatacaaaaattagctggatgtggtggcatgcacctgtaatcccagctactcaggaggctgaggctggagaatcacttgaatccaggaggcggaggtttcagtgagcagagatcacgccactgcactcctgccttggcgacagagcaagactctgtctc

SEQ ID NO: 357980 - DNA, 243 bp, Homo sapiens
gcggcgcctactactactaaattcgcggccgcgtcgaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttg

SEQ ID NO: 357981 - DNA, 5400 bp, Homo sapiens
aaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcaagggccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttgaaaaaaaaaaaaaaaaaaaaaaaaaaaaaaaaaaagaaaaaaaaacaaaacaaaacagaaaaaaaaaaaaagggggggggggcgccctcgcacacagaaaaaattctaaacacacagggggggggggccggcgacccatggggtaaaagctaacatgggccaagcgtgtccaaaggaacaccggggacaagagaacggggggtcgcggcatcctcacaacaaaaagaaacagcggcgccggagaacacgccgcgcgtgcttgagacaacaccgcgagaggggagcctgcacgggcgtacacgcggccactacacacacagagcggaccccccgagagacagaaaaaaggg

SEQ ID NO: 357982 - DNA, 5579 bp, Homo sapiens
  misc_feature (5126)..(5126): n is a, c, g, or t
  misc_feature (5134)..(5135): n is a, c, g, or t
  misc_feature (5137)..(5137): n is a, c, g, or t
  misc_feature (5140)..(5140): n is a, c, g, or t
  misc_feature (5279)..(5279): n is a, c, g, or t
aaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcaagggccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttgaaaaaaaaaaaaaaaaaaaaaaaaaaaaaaaaaaagaaaaaaaaacaaaacaaaacagaaaaaaaaaaaaaaaaanaaataaannanaanaaaatataaataaaaaaaaatttaaaaatataataaaaaaattaatataattaaaaaaattattataatattattaaaattaataatttattaaattttttataaaaatattttaaaatttaataaatttttaaattanaaaaataaaatttttttaaaaataattattttttatataatatattatataataaaaaatatttaaattttattgtttttttaaaattttaaaatatttattttataaatatattttgtaaattttttatttatatatattttatataattttttataaattaattaaatttttaatttatatatataatttaaaaaattattttttatttattatattatattataaaattttaattattttaatatttttatataattattaattttattaaaatttttatttataattatttataaa

SEQ ID NO: 357983 - DNA, 5452 bp, Homo sapiens
  misc_feature (5090)..(5090): n is a, c, g, or t
  misc_feature (5098)..(5099): n is a, c, g, or t
  misc_feature (5101)..(5101): n is a, c, g, or t
  misc_feature (5104)..(5104): n is a, c, g, or t
  misc_feature (5205)..(5205): n is a, c, g, or t
  misc_feature (5214)..(5214): n is a, c, g, or t
  misc_feature (5349)..(5349): n is a, c, g, or t
  misc_feature (5371)..(5372): n is a, c, g, or t
  misc_feature (5382)..(5382): n is a, c, g, or t
  misc_feature (5430)..(5430): n is a, c, g, or t
aaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcaagggccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttgaaaaaaaaaaaaaaaaaaaaaaaaaaaaaaaaaaaaaaanaaataaannanaanaaaataaatttaacatccatttttctaatcctaccaattctcaccctactcccgactaatctccactcctacatacttccccctttattcctataaccatnccacctgcnactcctttacaacaacaatctaacccaacttccccattgtacccaccattcctattctaattacctcacaatatttctgacacttcttaacctaccccacattccaccttaaaaccccataaaaattcccaatcnataatccaaaccaattttaacnntaaaaaaccncccatctctctaaaataaaacccctcaaaaactttcaataaaatcccnatttaccaattaaacccctttt

SEQ ID NO: 357984 - DNA, 5211 bp, Homo sapiens
aaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcaagggccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttgtacagcatcaattttcttacattttctgtgttttgtaagggaactgtttccttcatgccgccatgttcctgatattagttctgatttcttttttaacaaatgttatcatgattaagaaaatttccagcacttttaatggccaattaacctgagaatggtta

SEQ ID NO: 357985 - DNA, 3215 bp, Homo sapiens
  misc_feature (13)..(13): n is a, c, g, or t
gctgacctagagnatcccaggcaaagctctacccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttg

SEQ ID NO: 357986 - DNA, 2844 bp, Homo sapiens
ggcccaagatcggcatggaaaactggggaacttaatttttcatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttg

SEQ ID NO: 357987 - DNA, 2012 bp, Homo sapiens
gtgagtggaagggaccccaagtctcctctgctctcaacttggacacatctaagtttgctgggggccttcatttctcaggaccaaaggtggaaggaggtgtgaaaggaggtcagattggactccaggctcctggaaaggggtgtctgggcctctctctccatcagatcggggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttg

SEQ ID NO: 357988 - DNA, 1166 bp, Homo sapiens
agaagatgatatcttctacggatgctccatggtaggagttacctctccctactaagggaggctagactgttcaacctgttcccgctccgccttccactatagcagatccgagcaggagtaggagagagggtggtaagagtcagaagcttatattgtttatccggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttg

SEQ ID NO: 357989 - DNA, 452 bp, Homo sapiens
gcggcgcctactactactaaattcgcggccgcgtcgacgacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttg

SEQ ID NO: 357990 - DNA, 431 bp, Homo sapiens
tccttctcacctgtgtatcaacatattgggatcagtaatttagatgaaagtatactacaaaaggagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttg

SEQ ID NO: 357991 - DNA, 5050 bp, Homo sapiens
aaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcaagggccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttg

SEQ ID NO: 357992 - DNA, 5651 bp, Homo sapiens
aaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcaagggccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttgaaaaaaaaaaaaaaaaaaaaaaaaaaaaaaaaaaaagaggggggggggggaaaatttccccggagggggcaccacagtgttaccgttccccaccgcttttgttgatcaagaaggggggccccaatagaagggggcggcaatattataatacgaagaagacagacggggcgacggatgtttaacaaagcggtgtcgaggaggcggggaaaagccgtggtgaaaccggggacacatgtgggggagagagggagcccccttcaaaccttcgcgggagcggggagggcagaccacaagtggggcggcaagacactcttcctcgccaacgagaatatgttttagacaggcgcgccgagagagcggcagaatatatatatgaaaatttgtgtaccggacggtggtgtacatagagagcgtgctttggtagacaacacaaaggggatcaaataatatgactgtcgggaaggcaagcgaaagaagaaatttttgtggctccacagcgcggggaaattataatattttgtgagaaattgtattttttgtaacccggcgggcgtctgttttgttcttaataaacgggaaattgagaacaaccacaaaaaca

SEQ ID NO: 357993 - DNA, 4996 bp, Homo sapiens
aaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcaagggccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttg

SEQ ID NO: 357994 - DNA, 2082 bp, Homo sapiens
gcaaacttagatgtgtccaagttgagagcagaggagacttggggtccttccactcacccccggaacctttaacactcaaatgcccttcaccaaggtcagccttgggcaggttcatatccatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttg

SEQ ID NO: 357995 - DNA, 4813 bp, Homo sapiens
aaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcaagggccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttg

SEQ ID NO: 357996 - DNA, 1730 bp, Homo sapiens
ccatgtgggcatcacgggatagccatgtggggcatcacggccatgtggggcatcacgggggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttg

SEQ ID NO: 357997 - DNA, 2147 bp, Homo sapiens
cattcaaagagagggagttagtgcagggtaccgagatcaggaagaggagtggtgcagaggtgggaggtgatgagactcaagactacagagagaagaaagggccggcagcccagatcccagccccacccctcctgccctgcattcaggcagagcacagagggataaagagggaggtgggttgggggacaaggcagagatgcatatacctgggacgtacacctgcgtggagcccagaaggaggcttctgtccgccacactgctagtccccagggcccccttgcaagtggacatcatgttaccccacatgcatgtgacttggccagaggagacagagtcttcatgtgaactggaaaaagatccccctctcccggtggatacatttgacaaacaaaaagtgggctggttttcagcccctgctcatctcattggcccaatacctgtgcagtgagcaacctgcacagctgtacttggtgatcatggtttcctcccagggtgctctggctaggggtgccgcccacccactgctatgaaccccctgcatgggatggtggttgtggttatgaaggaggtgtgttgctgtgttaggaacaggcctgggctgagagaaggggactcagtcaggcagctgggcagagacatggacagcagggctgaggtgataagagggacctccacggacatcaaagcaggtgatggagccaacagcctgctggtttggagcaggacctatgaccagaggtgagacgctcagaggggcctgggcccctccctttaacccaaggcactccaggcttcgctattgcacctgaggacacgtgcacccagtgtcacagcccatggggcctgtgacatccaggccagagacctcgggcggctccctccactcctcacccccctgtctccaggcatctcagggccatcctaaacccctgatcacccgtctttgtcccaaccctgagactcgggacactccacaggaggccactttggaagctcggaacatccccctgcccatctagcatcttatttgcataaaacaaaagggggctggcactcaggatatttcatgggctcatgacatggcgtgtggtggcgcattccagtacagtatccatcctctccgccatcgccggggactgccaggatgagacttgctgccaccggggctcccatgagctcagccacacctggaacccctctgacacccacacctaccataatgaaccccaaaaccctgtccagaaactcaggaggagggaatctcaaggacaggacaactgtctccagccagcagccttgcttggagaagatgcctcccgaccacctttctggccgtttagccctcatccatttccccatccaaggctccaccctaacccaccctggtaattcctgggcctgaacgcaccgtcaatgaccaaagcttgggaggatgctgtggccaggtgtgggcagcgtgatgtggaccccacaaatggattcagagggctgggtgccgtgactcatgcctggaatcccagcactttgggaggccaaggtggaaggatcacttgaggtcgggaattcgagagcagcctgaccaacatggtgcaaccctgtctgtactaaaaatacaaaaattagccgggcgcagtggcacgcacctgtaatcccagctactcaggaggctgaggcaggggaatcgcttgaacccgggaggcagaggtcgcagtgagctgagatcacatcattgcactccagcctgggcaacagagagagacgctgtctccaaaaaaaaaaaaaaaaaacaaaaacgcactcagagggttggatgaaggaggcggctccagcctggactagccggcaagagacagcatcactggggaccatcgtcccaggcccgatcctctcctgtagtcagtcctggtctggaccactcaaggacagagatggaagcttgaaccccattcagcagggcccacaggtctctgtccctggtggaaggacaagggatgagaggacagatacatctgccacccctcacccatcggcacctgtgccctctctagccacaggcccccgctcacggccagttctgcttagatatggattctcaccaaatcctgctatttccatatccatagatcctttcctggggatcagaaaaa

SEQ ID NO: 357998 - DNA, 560 bp, Homo sapiens
tttttttttctctcttttttttttgagacggagtcttgcctctgttgcccaggctggagtaaaatggcacaatcttggctcactgcaacctctgccttctgggttcaagcgattctcctgcctcagcctcccaaagtgctgggattacaggcatgagccactatgcctggccacctctcccactcttatgtcaacctcacaagggtaggtacttgtgtgtgccctgttcactgctgtgtctccaaacctgttacattcagtaggcgctcggtcaatactcatctagtaaaaagcagcccctcttagactcagcccaagcccaggaccactcaaggacagagatggaagcttgaaccccattcagcagggcccacaggtctctgtccctggtggaaggacaagggatgagaggacagatacatctgccacccctcacccatcggcacctgtgccctctctagccacaggcccccgctcacggccagttctgcttagatatggattctcaccaaatcctgctatttccatatccatagatcctttcctggggatcagaaaaa

SEQ ID NO: 357999 - DNA, 2803 bp, Homo sapiens
ccccttatggtcgcccctttgccggtctccccctggggaatttctttttgttcggcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358000 - DNA, 1018 bp, Homo sapiens
ccagattgtgtcactgcactccagcctgggcaacaaggcgagactctatctcaaaacaaacaaacaaacaaacaaacaaaaacccaagaaggaacaaatcctgattttggaaagaattcagtaagtcttctctaatgagcctcctcaaaacacttctccttcaggcaaggagcctttttttcccctttagaacaaccatttacagcatctgaggccttttttaagggccaggtctcttccctgctgttaggtttttaattttaaggtcaagtttctaacaaaatttgttttgttgttgtgagattaaactggccatatgagcattaaaaccatctgcttctgaaatagcaagctgaaactcaaccggggaccgggaattcatttgcagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtaaaggctgccaagaggcttctgcggggcacttcgggaggccaaggtggacggatcacgtcaggagatcgagaccatcctggctaacatggtgaaaccctgtctctactaaaaaaaatacaaaaaattagctggcctggtggcaggtgcctatagtcccagctattcaggaggctgaggcaggagaatggcgtgaacccaggaggcggagcttgcagtgagccgagattgcgccactgcactccagcctgggcgacagaacgagactctgtctcaaaaaaaa

SEQ ID NO: 358001 - DNA, 465 bp, Homo sapiens
tggcttgtatggatatctgccttttattaccaggttttgattcatggattcacccagtcattacttctagatgatgctggctcagttctggccacagccaccagctgggatgagctagaaattcaggaggaggcagagtctggcagcagtgtcacatccaagatccgactccctgcacaggtgagcagggaccatgggctgaaaaagggaataaactgctccgtggaaaagaagaaagattttagaaaatcattcaacatacaacttctgaggaatagctgaaagtaacatctgtaattttctactgtgggggcatagtagatgtagggctaagtaaatggcagactgttcaagaagtcagttaaccattctttccttttgtagcataggctctgtgctaattagggaaccacttacttgccgtgaaatcagcagcataaaacacaggcacctcttcgagatcag

SEQ ID NO: 358002 - DNA, 6030 bp, Homo sapiens
agcgggcgggcgccaggcgcgcggagagcggcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgccccgcctcctcgcgcccgccccctcgggtaacaaacatggcccccggcggggcggaagcgcttccgcccccaacgaagatggcggagggggggcgggactaaaagggggtaggtggatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttggtgccaagagcaagaggctcatccgtggatgggtccccacctcccaccgagccacccatgatcagctcccttttaaataactgattaagaactgaatgacaaaatgcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358003 - DNA, 5345 bp, Homo sapiens
agcgggcgggcgccaggcgcgcggagagcggcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgccccgcctcctcgcgcccgccccctcgggtaacaaacatggcccccggcggggcggaagcgcttccgcccccaacgaagatggcggagggggggcgggactaaaagggggtaggtggatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttggtgccaagagcaagaggctcatccgtggatgggtccccacctcccaccgagccacccatgatcagctcccttttaaataactgattaagaactgaatgacaaaatgcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggca

SEQ ID NO: 358004 - DNA, 4804 bp, Homo sapiens
agcgggcgggcgccaggcgcgcggagagcggcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgccccgcctcctcgcgcccgccccctcgggtaacaaacatggcccccggcggggcggaagcgcttccgcccccaacgaagatggcggagggggggcgggactaaaagggggtaggtggatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttggtgccaagagcaagaggctcatccgtggatgggtccccacctcccaccgagccacccatgatcagctcccttttaaataactgattaagaactgaatgacaaaatgcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcttttagattcttgtatacccagataacttctgtgtcactattccaccagagtctgcacctcagactttagtaggaaacatggcacagtttctgcaagtaaagtaatatgtaatgactttttgtcctacaaacttggtcagtcagcagcttacatgatctcatg

SEQ ID NO: 358005 - DNA, 6918 bp, Homo sapiens
agcgggcgggcgccaggcgcgcggagagcggcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgccccgcctcctcgcgcccgccccctcgggtaacaaacatggcccccggcggggcggaagcgcttccgcccccaacgaagatggcggagggggggcgggactaaaagggggtaggtggatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaaggtaggtgtctgaatgtttgcccattaaaaacacaaattaaacaaaagaaaaccttagcattgtcttgggtttgagcagttcacatcaaagactcaaactgttaaggatcacccagcccaggcatcgggtcctgtaaaaatgctctatcttaggagtagcacccagcgctgtgagtttacttacactcattctaaagggtcagcagatcttcgctaagaaggcagctcagcacagatggaaacaccaagacccagaactttgggaggctgaggtgggaggatggcttcagcttgggagttcacggctgcaatgagcagctatcatctcaccactgcactccagcctgggcgacaaagcaagaccctgtctcaagtcctctctcttcatgggtggggaccgggaattcatttgcagaaagaaggtgcatttccagtcacccagaaccgggcgctgcagctgctttatgatctgcgttacctcaacattgttctgacagccaagggtgacgaggtgaagagtggccggagcaagccagactccaggtgtcgtatcctctagggagctatgtcaaggcggtctcttccaaaagcaaatagtccctttgctgggaagccaccagagtcagcctgttatactgcacattcattgtgtttgttttgaacagtaagtgctcatattaccagcaagttaaataatggccgcctgctggataaatgcaatggtcaagtgaaataggtggactcttattcccctctcttctgagtcagcctagcagctgctgagtatcatttgagcccttagtgccctccttatagacagaacagggggaaagggtggacttcacttagacatcatgcttgagggtgacttaagcactatcatcagtgacaaacgtactaagccagcaactaagtagaataaaacccaactccaagatttctacagcagtaggatatcataagattgtttttgatcctaaaaaatgtggacagtaatgatcctaatccttttctcagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttggtgccaagagcaagaggctcatccgtggatgggtccccacctcccaccgagccacccatgatcagctcccttttaaataactgattaagaactgaatgacaaaatgcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358006 - DNA, 4652 bp, Homo sapiens
tggtcccggtgttatttagtgacgagggcgggactattgctgtatgtgactagggcggcgagcctaccccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358007 - DNA, 5585 bp, Homo sapiens
agcgggcgggcgccaggcgcgcggagagcggcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgccccgcctcctcgcgcccgccccctcgggtaacaaacatggcccccggcggggcggaagcgcttccgcccccaacgaagatggcggagggggggcgggactaaaagggggtaggtggatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358008 - DNA, 5011 bp, Homo sapiens
agcgggcgggcgccaggcgcgcggagagcggcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgccccgcctcctcgcgcccgccccctcgggtaacaaacatggcccccggcggggcggaagcgcttccgcccccaacgaagatggcggagggggggcgggactaaaagggggtaggtggatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcagtacgatgccaactgttaagcctgcaggaatcctcctgggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358009 - DNA, 4143 bp, Homo sapiens
ccagattgtgtcactgcactccagcctgggcaacaaggcgagactctatctcaaaacaaacaaacaaacaaacaaacaaaaacccaagaaggaacaaatcctgattttggaaagaattcagtaagtcttctctaatgagcctcctcaaaacacttctccttcaggcaaggagcctttttttcccctttagaacaaccatttacagcatctgaggccttttttaagggccaggtctcttccctgctgttaggtttttaattttaaggtcaagtttctaacaaaatttgttttgttgttgtgagattaaactggccatatgagcattaaaaccatctgcttctgaaatagcaagctgaaactcaaccaaaacttgaagctgtttattacgctcacataccaagtcctctctcttcatgggtggggaccgggaattcatttgcagaaagaaggtgcatttccagtcacccagaaccgggcgctgcagctgctttatgatctgcgttacctcaacattgttctgacagccaagggtgacgaggtgaagagtggccggagcaagccagactccaggtgtcgtatcctctagggagctatgtcaaggcggtctcttccacattcattgtgtttgttttgaacagtaagtgctcatattaccagcaagttaaataatggccgcctgctggataaatgcaatggtcaagtgaaataggtggactcttattcccctctcttctgagtcagcctagcagctgctgagtatcatttgagcccttagtgccctccttatagacagaacagggggaaagggtggacttcacttagacatcatgcttgagggtgacttaagcactatcatcagtgacaaacgtactaagccagcaactaagtagaataaaacccaactccaagatttctacagcagtaggatatcataagattgtttttgatcctaaaaaatgtggacagtaatgatcctaatccttttctcagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttggtgccaagagcaagaggctcatccgtggatgggtccccacctcccaccgagccacccatgatcagctcccttttaaataactgattaagaactgaatgacaaaatgcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358010 - DNA, 4197 bp, Homo sapiens
ccagattgtgtcactgcactccagcctgggcaacaaggcgagactctatctcaaaacaaacaaacaaacaaacaaacaaaaacccaagaaggaacaaatcctgattttggaaagaattcagtaagtcttctctaatgagcctcctcaaaacacttctccttcaggcaaggagcctttttttcccctttagaacaaccatttacagcatctgaggccttttttaagggccaggtctcttccctgctgttaggtttttaattttaaggtcaagtttctaacaaaatttgttttgttgttgtgagattaaactggccatatgagcattaaaaccatctgcttctgaaatagcaagctgaaactcaaccaaaacttgaagctgtttattacgctcacataccaagtcctctctcttcatgggtggggaccgggaattcatttgcagaaagaaggtgcatttccagtcacccagaaccgggcgctgcagctgctttatgatctgcgttacctcaacattgttctgacagccaagggtgacgaggtgaagagtggccggagcaagccagactccaggtgtcgtatcctctagggagctatgtcaaggcggtctcttccaaaagcaaatagtccctttgctgggaagccaccagagtcagcctgttatactgcacattcattgtgtttgttttgaacagtaagtgctcatattaccagcaagttaaataatggccgcctgctggataaatgcaatggtcaagtgaaataggtggactcttattcccctctcttctgagtcagcctagcagctgctgagtatcatttgagcccttagtgccctccttatagacagaacagggggaaagggtggacttcacttagacatcatgcttgagggtgacttaagcactatcatcagtgacaaacgtactaagccagcaactaagtagaataaaacccaactccaagatttctacagcagtaggatatcataagattgtttttgatcctaaaaaatgtggacagtaatgatcctaatccttttctcagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttggtgccaagagcaagaggctcatccgtggatgggtccccacctcccaccgagccacccatgatcagctcccttttaaataactgattaagaactgaatgacaaaatgcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358011 - DNA, 3723 bp, Homo sapiens
ccagattgtgtcactgcactccagcctgggcaacaaggcgagactctatctcaaaacaaacaaacaaacaaacaaacaaaaacccaagaaggaacaaatcctgattttggaaagaattcagtaagtcttctctaatgagcctcctcaaaacacttctccttcaggcaaggagcctttttttcccctttagaacaaccatttacagcatctgaggccttttttaagggccaggtctcttccctgctgttaggtttttaattttaaggtcaagtttctaacaaaatttgttttgttgttgtgagattaaactggccatatgagcattaaaaccatctgcttctgaaatagcaagctgaaactcaaccaaaacttgaagctgtttattacgctcacataccaagtcctctctcttcatgggtggggaccgggaattcatttgcagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttggtgccaagagcaagaggctcatccgtggatgggtccccacctcccaccgagccacccatgatcagctcccttttaaataactgattaagaactgaatgacaaaatgcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358012 - DNA, 4143 bp, Homo sapiens
ccagattgtgtcactgcactccagcctgggcaacaaggcgagactctatctcaaaacaaacaaacaaacaaacaaacaaaaacccaagaaggaacaaatcctgattttggaaagaattcagtaagtcttctctaatgagcctcctcaaaacacttctccttcaggcaaggagcctttttttcccctttagaacaaccatttacagcatctgaggccttttttaagggccaggtctcttccctgctgttaggtttttaattttaaggtcaagtttctaacaaaatttgttttgttgttgtgagattaaactggccatatgagcattaaaaccatctgcttctgaaatagcaagctgaaactcaaccggggaccgggaattcatttgcagaaagaaggtgcatttccagtcacccagaaccgggcgctgcagctgctttatgatctgcgttacctcaacattgttctgacagccaagggtgacgaggtgaagagtggccggagcaagccagactccaggtgtcgtatcctctagggagctatgtcaaggcggtctcttccaaaagcaaatagtccctttgctgggaagccaccagagtcagcctgttatactgcacattcattgtgtttgttttgaacagtaagtgctcatattaccagcaagttaaataatggccgcctgctggataaatgcaatggtcaagtgaaataggtggactcttattcccctctcttctgagtcagcctagcagctgctgagtatcatttgagcccttagtgccctccttatagacagaacagggggaaagggtggacttcacttagacatcatgcttgagggtgacttaagcactatcatcagtgacaaacgtactaagccagcaactaagtagaataaaacccaactccaagatttctacagcagtaggatatcataagattgtttttgatcctaaaaaatgtggacagtaatgatcctaatccttttctcagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttggtgccaagagcaagaggctcatccgtggatgggtccccacctcccaccgagccacccatgatcagctcccttttaaataactgattaagaactgaatgacaaaatgcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358013 - DNA, 3478 bp, Homo sapiens
agcgggcgggcgccaggcgcgcggagagcggcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgccccgcctcctcgcgcccgccccctcgggtaacaaacatggcccccggcggggcggaagcgcttccgcccccaacgaagatggcggagggggggcgggactaaaagggggtaggtggatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaaggtaggtgtctgaatgtttgcccattaaaaacacaaattaaacaaaagaaaaccttagcattgtcttgggtttgagcagttcacatcaaagactcaaactgttaaggatcacccagcccaggcatcgggtcctgtaaaaatgctctatcttaggagtagcacccagcgctgtgagtttacttacactcattctaaagggtcagcagatcttcgctaagaaggcagctcagcacagatggaaacaccaagacccagaactttgggaggctgaggtgggaggatggcttcagcttgggagttcacggctgcaatgagcagctatcatctcaccactgcactccagcctgggcgacaaagcaagaccctgtctcaagtcctctctcttcatgggtggggaccgggaattcatttgcagaaagaaggtgcatttccagtcacccagaaccgggcgctgcagctgctttatgatctgcgttacctcaacattgttctgacagccaagggtgacgaggtgaagagtggccggagcaagccagactccaggtgtcgtatcctctagggagctatgtcaaggcggtctcttccaaaagcaaatagtccctttgctgggaagccaccagagtcagcctgttatactgcacattcattgtgtttgttttgaacagtaagtgctcatattaccagcaagttaaataatggccgcctgtttgtgctactaaattctttcctc

SEQ ID NO: 358014 - DNA, 3145 bp, Homo sapiens
agcgggcgggcgccaggcgcgcggagagcggcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgccccgcctcctcgcgcccgccccctcgggtaacaaacatggcccccggcggggcggaagcgcttccgcccccaacgaagatggcggagggggggcgggactaaaagggggtaggtggatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaaggtaggtgtctgaatgtttgcccattaaaaacacaaattaaacaaaagaaaaccttagcattgtcttgggtttgagcagttcacatcaaagactcaaactgttaaggatcacccagcccaggcatcgggtcctgtaaaaatgctctatcttaggagtagcacccagcgctgtgagtttacttacactcattctaaagggtcagcagatcttcgctaagaaggcagctcagcacagatggaaacaccaagacccagaactttgggaggctgaggtgggaggatggcttcagcttgggagttcacggctgcaatgagcagctatcatctcaccactgcactccagcctgggcgacaaagcaagaccctgtctcttaaaaagacaaaacaaaaaaatcaa

SEQ ID NO: 358015 - DNA, 2751 bp, Homo sapiens
cgatgaaactgccttgggaaaagggtagacacaggcacttctctccacagtctgctaacctaatgtgggcagaactgaaagatcactgcagtggaaactgttctggaagaggctgcaacatagcccatgcttagggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358016 - DNA, 1935 bp, Homo sapiens
ctgtcgcccgcagtaaggtttgtcgaccacgcgtcggcatggcatcagtcagatcaaggtttggacttctcccactgagcatgacaagcactcgaaaggctaaatcaaccagaaacatcgaaacaaaagctcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358017 - DNA, 1046 bp, Homo sapiens
tttttttgtttttcctgagacagcctcctgagtagctgcgatcccagctactcaggaggctgaggcaggagaatcactggaacccgggatgtttgattcccaaaataattgtgtatatttaccctaggagttctgaaggaagtcagtttaggcttgggttgttcttagtaaggagggaccttaagggcatgatgagatttggaatttaggtttcttagtccatttgtgctgccataacaaaatacctgagattgggcaatttataacacaagtgtatttttcacagttgtgggtctgggaagtccaagattaaggcactggcctttgatgtctggtgagggccttcttgctgtatcctcacgtgggggaaggtagaagaacctaaaagttgcctccagcccttttatgaggcactgatccatttgctgtggtttggatttgtgtcttgcccacatctcatgttgaattataatccccaatgttggaggtggggcctggtgggagacgaaagtttgcctcttcgtggggctgagcaaaaatgcacgcgtgtgtaggaaaaaccatgggatcttacaacactcctgactctggcaactcttctacactgggctttgatgacttgctgagttgtactgaacccagcttaatagaagttttgtatccttaaatacccccagatttcttcctaagcctacagaacactgagattgcttttgttcgttcttctggtttagttctgtgccttcccctgcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtaagtggatccagcgcaaagagctgctctggtggtggccaggcttc

SEQ ID NO: 358018 - DNA, 982 bp, Homo sapiens
  misc_feature (971)..(971): n is a, c, g, or t
tttttttgtttttcctgagacagcctcctgagtagctgcgatcccagctactcaggaggctgaggcaggagaatcactggaacccgggatgtttgattcccaaaataattgtgtatatttaccctaggagttctgaaggaagtcagtttaggcttgggttgttcttagtaaggagggaccttaagggcatgatgagatttggaatttaggtttcttagtccatttgtgctgccataacaaaatacctgagattgggcaatttataacacaagtgtatttttcacagttgtgggtctgggaagtccaagattaaggcactggcctttgatgtctggtgagggccttcttgctgtatcctcacgtgggggaaggtagaagaacctaaaagttgcctccagcccttttatgaggcactgatccatttgctgtggtttggatttgtgtcttgcccacatctcatgttgaattataatccccaatgttggaggtggggcctggtgggagacgaaagtttgcctcttcgtggggctgagcaaaaatgcacgcgtgtgtaggaaaaaccatgggatcttacaacactcctgactctggcaactcttctacactgggctttgatgacttgctgagttgtactgaacccagcttaatagaagttttgtatccttaaatacccccagatttcttcctaagcctacagaacactgagattgcttttgttcgttcttctggtttagttctgtgccttcccctgcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcattaataagttaccccgataacatgtgccctgtctctactacccagagtnaaacaagaaaa

SEQ ID NO: 358019 - DNA, 362 bp, Homo sapiens
ttggagacagggtctcaccttgttgcccaggcttgagtgtagtggcatgatcatgggtcactgcagcctcgacctcctgggctcaaatgatcctcctacctcagtctcccaagtagctgcaactacaggtgtgcaccatgacgcctggcaaattgtttcttttttgtagaggtgaggtttcactgtgttgcccaagctggcctggcctaactccctgtttcaatatgcacttcaaagggtggcctagatggcttctcacttggccttctctttaggaaagggcactggtgtcctgcaggaagagatgaaactctgcagctggtttaaacacctgccagcatccatcgtcgagttccagccaa

SEQ ID NO: 358020 - DNA, 5930 bp, Homo sapiens
agcgggcgggcgccaggcgcgcggagagcggcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgccccgcctcctcgcgcccgccccctcgggtaacaaacatggcccccggcggggcggaagcgcttccgcccccaacgaagatggcggagggggggcgggactaaaagggggtaggtggatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttggtgccaagagcaagaggctcatccgtggatgggtccccacctcccaccgagccacccatgatcagctcccttttaaataactgattaagaactgaatgacaaaatgcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358021 - DNA, 4973 bp, Homo sapiens
agcgggcgggcgccaggcgcgcggagagcggcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgccccgcctcctcgcgcccgccccctcgggtaacaaacatggcccccggcggggcggaagcgcttccgcccccaacgaagatggcggagggggggcgggactaaaagggggtaggtggatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358022 - DNA, 6504 bp, Homo sapiens
agcgggcgggcgccaggcgcgcggagagcggcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgccccgcctcctcgcgcccgccccctcgggtaacaaacatggcccccggcggggcggaagcgcttccgcccccaacgaagatggcggagggggggcgggactaaaagggggtaggtggatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccaggtgtcgtatcctctagggagctatgtcaaggcggtctcttccaaaagcaaatagtccctttgctgggaagccaccagagtcagcctgttatactgcacattcattgtgtttgttttgaacagtaagtgctcatattaccagcaagttaaataatggccgcctgctggataaatgcaatggtcaagtgaaataggtggactcttattcccctctcttctgagtcagcctagcagctgctgagtatcatttgagcccttagtgccctccttatagacagaacagggggaaagggtggacttcacttagacatcatgcttgagggtgacttaagcactatcatcagtgacaaacgtactaagccagcaactaagtagaataaaacccaactccaagatttctacagcagtaggatatcataagattgtttttgatcctaaaaaatgtggacagtaatgatcctaatccttttctcagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttggtgccaagagcaagaggctcatccgtggatgggtccccacctcccaccgagccacccatgatcagctcccttttaaataactgattaagaactgaatgacaaaatgcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358023 - DNA, 4993 bp, Homo sapiens
agcgggcgggcgccaggcgcgcggagagcggcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgccccgcctcctcgcgcccgccccctcgggtaacaaacatggcccccggcggggcggaagcgcttccgcccccaacgaagatggcggagggggggcgggactaaaagggggtaggtggatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagttctgtgccttcccctgcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358024 - DNA, 5045 bp, Homo sapiens
tttttttgtttttcctgagacagcctcctgagtagctgcgatcccagctactcaggaggctgaggcaggagaatcactggaacccgggatgtttgattcccaaaataattgtgtatatttaccctaggagttctgaaggaagtcagtttaggcttgggttgttcttagtaaggagggaccttaagggcatgatgagatttggaatttaggtttcttagtccatttgtgctgccataacaaaatacctgagattgggcaatttataacacaagtgtatttttcacagttgtgggtctgggaagtccaagattaaggcactggcctttgatgtctggtgagggccttcttgctgtatcctcacgtgggggaaggtagaagaacctaaaagttgcctccagcccttttatgaggcactgatccatttgctgtggtttggatttgtgtcttgcccacatctcatgttgaattataatccccaatgttggaggtggggcctggtgggagacgaaagtttgcctcttcgtggggctgagcaaaaatgcacgcgtgtgtaggaaaaaccatgggatcttacaacactcctgactctggcaactcttctacactgggctttgatgacttgctgagttgtactgaacccagcttaatagaagttttgtatccttaaatacccccagatttcttcctaagcctacagaacactgagattgcttttgttcgttcttctggtttagttctgtgccttcccctgcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358025 - DNA, 4533 bp, Homo sapiens
aggctagtgaggccgggggtgaatcggccgagggttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttggtgccaagagcaagaggctcatccgtggatgggtccccacctcccaccgagccacccatgatcagctcccttttaaataactgattaagaactgaatgacaaaatgcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgatggaatgtggccccctagttactgttgggggttactttaagcatcaagttaatccttgtcccaaaatttcacaatacttgttgctttagacatcagttcaggtagcttacattttatcagcgttcaacaacaccttaattgttgacactacaaggtggaattgtcaatgagatcatgtaagctgctgactgaccaagtttgtaggacaaaaagtcattacatattactttacttgcagaactgtgccatgtttcctactaaagtctgaggtgcagactctggtggaatagtgacacagaagttatctgggtatacaagaatctaaaagacattctccctggaaatacaaatatataacaaagagtagagactattattagggagtgtgcttcactgacagtctgaattggatctgattgttctcctgttacacaggagagagtactttcaatagaacatctacatactgagaggtagtatggcagttaatttcagtgcaagactgaatcaagcttcctatattttggaaaaaaacttatgttttttcatggaaactagatactctttactagtttattgaataaaaaaaattgaagatcccgcatttttaaaaggccctttacataaagtagagtttctagttgacagatttggaaatcagtctgaatgggacatactatggattcaacacacagaatgagttttcctcaaaccactaccttgacatagatttgataccctccctcaaaagaatcctataaaaaattgcttcaaagcccctttgaaattgcaatagtgcagcaaaaccacaagtaaacaactgcctgttaacctgttatttcaaatatagactgaaaagccaacaggcatttttcgtgtgcaatttttcttttaaaacaagttgtaagttgaaatatcaaatctgcacagcgctgtcccttcacagaaggcaagaaactgccggcacatcatgtcagaggccgccctcggtgctgtaggctgtggaagtgggcctccctcagggtctggttgatgtggaagtagaggccttggcacagcgcggactgctcgggcacgggctgaggcgtgttagggctggatccggccatggtctggctcaagctgccttccggcccgctggccctgtccgggctgttgatgctgctgctgctgctgctgctgctcccaccactgtcactgcctgaagactctgtgtcccaggaatcctgaaagacagggtttctgctacttcttttggtctgggggggaagatggttgtcttcttcgttgccattccttctccttttcctgggacggaggcgctcgctcatggcagctggcggatggaagctacgcggcgccgctccgcgaagagagggaacagagggggttgtgtttcggcggccgccacgcccaccccctcgggccttggctctcgcagccgctcgggtggacgcagccggtggcgagtacccctcagtcggacccgtaccaccactacttccggcgtctgctccgcgcccccccatgtcgctgccgccgtggtaccgccct

SEQ ID NO: 358026 - DNA, 3379 bp, Homo sapiens
agcgggcgggcgccaggcgcgcggagagcggcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgccccgcctcctcgcgcccgccccctcgggtaacaaacatggcccccggcggggcggaagcgcttccgcccccaacgaagatggcggagggggggcgggactaaaagggggtaggtggatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtaaaggctgccaagaggcttctgcggggcacttcgggaggccaaggtggacggatcacgtcaggagatcgagaccatcctggctaacatggtgaaaccctgtctctactaaaaaaaatacaaaaaattagctggcctggtggcaggtgcctatagtcccagctattcaggaggctgaggcaggagaatggcgtgaacccaggaggcggagcttgcagtgagccgagattgcgccactgcactccagcctgggcgacagaacgagactctgtctcaaaaaaaa

SEQ ID NO: 358027 - DNA, 3853 bp, Homo sapiens
agcgggcgggcgccaggcgcgcggagagcggcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgccccgcctcctcgcgcccgccccctcgggtaacaaacatggcccccggcggggcggaagcgcttccgcccccaacgaagatggcggagggggggcgggactaaaagggggtaggtggatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccaggtgtcgtatcctctagggagctatgtcaaggcggtctcttccaaaagcaaatagtccctttgctgggaagccaccagagtcagcctgttatactgcacattcattgtgtttgttttgaacagtaagtgctcatattaccagcaagttaaataatggccgcctgctggataaatgcaatggtcaagtgaaataggtggactcttattcccctctcttctgagtcagcctagcagctgctgagtatcatttgagcccttagtgccctccttatagacagaacagggggaaagggtggacttcacttagacatcatgcttgagggtgacttaagcactatcatcagtgacaaacgtactaagccagcaactaagtagaataaaacccaactccaagatttctacagcagtaggatatcataagattgtttttgatcctaaaaaatgtggacagtaatgatcctaatccttttctcagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtaaaggctgccaagaggcttctgcggggcacttcgggaggccaaggtggacggatcacgtcaggagatcgagaccatcctggctaacatggtgaaaccctgtctctactaaaaaaaatacaaaaaattagctggcctggtggcaggtgcctatagtcccagctattcaggaggctgaggcaggagaatggcgtgaacccaggaggcggagcttgcagtgagccgagattgcgccactgcactccagcctgggcgacagaacgagactctgtctcaaaaaaaa

SEQ ID NO: 358028 - DNA, 2489 bp, Homo sapiens
agcgggcgggcgccaggcgcgcggagagcggcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgccccgcctcctcgcgcccgccccctcgggtaacaaacatggcccccggcggggcggaagcgcttccgcccccaacgaagatggcggagggggggcgggactaaaagggggtaggtggatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcggccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccagtgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaatggatcatggattcacccggtctggcgcagtgtccttccaggatcggtc

SEQ ID NO: 358029 - DNA, 498 bp, Homo sapiens
cggtaagtggatccagcgcaaagagctgctctggtggtggccaggcttcacattacgggtttatggcgtttgtcttctttcctgatgtaccaaagctctttacccaagatgtgaaaaacaccctggcgacttctgtcatcatttttctaggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgggtgtggcttctggccaacatttggtccttaaatatgggatggagaagggtgagctgcgggagactgaagcctccagagcgtcctctgtctttcactttgggaaaggtaattgtttcaaagaggatggtttcttcttttaggtgctggtatcaaggctcagat

SEQ ID NO: 358030 - DNA, 2000 bp, Homo sapiens
agcgggtcatcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacgctgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccag

SEQ ID NO: 358031 - DNA, 145 bp, Homo sapiens
ctggggccgagctgaggggctgaacacagcagtgaccgtgggtcagcctatttcccgcctccatttgatgtttccaggttttcaaaactgcatttaacctgcgccagagagttcaccgtaggcatctttaataaactaactccag

SEQ ID NO: 358032 - DNA, 3202 bp, Homo sapiens
agcgggtcatcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacgctgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaatgtgggtacgttactaacacaagatggaacttgagatttcctgaagcgcagtgttaaaatgcctcgagggcgtgtgccacatttccctgctgacgtaaaacacctggccagcaggaccggcttccggcaaagacccgcgcaaaccatgtcttgctgtttgacttacttaggaatgaggatgaccctgtattcctgggttagtcaaggtcagcttgccagagacggaggagggcgggggggccgtgaccctctagactgggaggaccaccaggagaggcactgggggctgcggccgggtgggcagatgccgccgtggctccatccatcagcacccagtcctttgcttcactgtgctctggccaagcgcgtgcgacttcctgtcacaccttaggcctgagcgcttattaagaaaacagtatgaaaaatgacaaacactcctgtccacagtctgagaatcccaagtgtctcaacacggtaccagaagtaccacctgggagcagcactggctatcttgggtcagggacacacaagcttgaacgtggcctcttagaggagctcgatgtcagatatgtaaacactggcacaagaaaatccagacactaagcattcaccgtgtcaattctgagacaggaaacaccgcccagagtgaggagcctgcgcagcccggggcccaggaggagaggccttcactcgcatgtcagtgtctcatctgggaccacagctgtgatgttctgctgtgcaatatgggtcacctttcgaaaaggccaaacaaaaggtgggctttcctgtgtccagcgactgccatgttttaggtaaagactttagtaaaggtggaggtaaaatcacttggtaaaacgttgagagtatttcttttctcgaatcaaaaacgctgacatgcaagtgggttccgcctctcccgcagtggggggccgagtgctgaacctacaaagccagtctgctccctgccagcttcgctgcccctcatggagggttgcatgaggacagatttaaattaaaaacaaaacactctacgtatcaaagaaatgtgtcaaaataatctcaaacaattaaaatataatatatatttataattccgggccctcaaagcaatcatggtagttaagaaccaagttttgagtcattaggatagaggccaactttaaacatctccagtgagatggaattaggaaactggca

SEQ ID NO: 358033 - DNA, 2602 bp, Homo sapiens
agcgggtcatcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacgctgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaatgtgggtacgttactaacacaagatggaacttgagatttcctgaagcgcagtgttaaaatgcctcgagggcgtgtgccacatttccctgctgacgtaaaacacctggccagcaggaccggcttccggcaaagacccgcgcaaaccatgtcttgctgtttgacttacttaggaatgaggatgaccctgtattcctgggttagtcaaggtcagcttgccagagacggaggagggcgggggggccgtgaccctctagactgggaggaccaccaggagaggcactgggggctgcggccgggtgggcagatgccgccgtggctccatccatcagcacccagtcctttgcttcactgtgctctggccaagcgcgtgcgacttcctgtcacaccttaggcctgagcgcttattaagaaaacagtatgaaaaatgacaaacactcctgtccacagtctgagaatcccaagtgtctcaacacggtagtcctcctccgtctcttggcaagctgaccttgactaacccaggaatacagggtcatcctcattcctaagtaagtacacagcagaacatgtcttcgggtcgtgtaagatcctgtagagtct

SEQ ID NO: 358034 - DNA, 3214 bp, Homo sapiens
cccacagctgagctcctgtagatggaaccagaggtgaggcaaggaactggaggccctccccactgaggtcagcggggcgcagacgcccccttgtcgtgccctgccttcctcctgcaatcctgcaggactctccagggccaagtgctgcccttggggccaaaaaacagggccttctccttcacctgccctgcagccattcaggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacgctgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaatgtgggtacgttactaacacaagatggaacttgagatttcctgaagcgcagtgttaaaatgcctcgagggcgtgtgccacatttccctgctgacgtaaaacacctggccagcaggaccggcttccggcaaagacccgcgcaaaccatgtcttgctgtttgacttacttaggaatgaggatgaccctgtattcctgggttagtcaaggtcagcttgccagagacggaggagggcgggggggccgtgaccctctagactgggaggaccaccaggagaggcactgggggctgcggccgggtgggcagatgccgccgtggctccatccatcagcacccagtcctttgcttcactgtgctctggccaagcgcgtgcgacttcctgtcacaccttaggcctgagcgcttattaagaaaacagtatgaaaaatgacaaacactcctgtccacagtctgagaatcccaagtgtctcaacacggtaccagaagtaccacctgggagcagcactggctatcttgggtcagggacacacaagcttgaacgtggcctcttagaggagctcgatgtcagatatgtaaacactggcacaagaaaatccagacactaagcattcaccgtgtcaattctgagacaggaaacaccgcccagagtgaggagcctgcgcagcccggggcccaggaggagaggccttcactcgcatgtcagtgtctcatctgggaccacagctgtgatgttctgctgtgcaatatgggtcacctttcgaaaaggccaaacaaaaggtgggctttcctgtgtccagcgactgccatgttttaggtaaagactttagtaaaggtggaggtaaaatcacttggtaaaacgttgagagtatttcttttctcgaatcaaaaacgctgacatgcaagtgggttccgcctctcccgcagtggggggccgagtgctgaacctacaaagccagtctgctccctgccagcttcgctgcccctcatggagggttgcatgaggacagatttaaattaaaaacaaaacactctacgtatcaaagaaatgtgtcaaaataatctcaaacaattaaaatataatatatatttataattccgggccctcaaagcaatcatggtagttaagaaccaagttttgagtcattaggatagaggccaactttaaacatctccagtgagatggaattaggaaactggca

SEQ ID NO: 358035 - DNA, 2852 bp, Homo sapiens
agctaggtacgaggctgggtgtgaatcggccgaggctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaatgtgggtacgttactaacacaagatggaacttgagatttcctgaagcgcagtgttaaaatgcctcgagggcgtgtgccacatttccctgctgacgtaaaacacctggccagcaggaccggcttccggcaaagacccgcgcaaaccatgtcttgctgtttgacttacttaggaatgaggatgaccctgtattcctgggttagtcaaggtcagcttgccagagacggaggagggcgggggggccgtgaccctctagactgggaggaccaccaggagaggcactgggggctgcggccgggtgggcagatgccgccgtggctccatccatcagcacccagtcctttgcttcactgtgctctggccaagcgcgtgcgacttcctgtcacaccttaggcctgagcgcttattaagaaaacagtatgaaaaatgacaaacactcctgtccacagtctgagaatcccaagtgtctcaacacggtaccagaagtaccacctgggagcagcactggctatcttgggtcagggacacacaagcttgaacgtggcctcttagaggagctcgatgtcagatatgtaaacactggcacaagaaaatccagacactaagcattcaccgtgtcaattctgagacaggaaacaccgcccagagtgaggagcctgcgcagcccggggcccaggaggagaggccttcactcgcatgtcagtgtctcatctgggaccacagctgtgatgttctgctgtgcaatatgggtcacctttcgaaaaggccaaacaaaaggtgggctttcctgtgtccagcgactgccatgttttaggtaaagactttagtaaaggtggaggtaaaatcacttggtaaaacgttgagagtatttcttttctcgaatcaaaaacgctgacatgcaagtgggttccgcctctcccgcagtggggggccgagtgctgaacctacaaagccagtctgctccctgccagcttcgctgcccctcatggagggttgcatgaggacagatttaaattaaaaacaaaacactctacgtatcaaagaaatgtgtcaaaataatctcaaacaattaaaatataatatatatttataattccgggccctcaaagcaatcatggtagttaagaaccaagttttgagtcattaggatagaggccaactttaaacatctccagtgagatggaattaggaaactggca

SEQ ID NO: 358036 - DNA, 2978 bp, Homo sapiens
agcgggtcatcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacgctgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatcatttaacctgcgccagagagttcaccgtaggcatctttaataaactaactccagcaaaatgtgggtacgttactaacacaagatggaacttgagatttcctgaagcgcagtgttaaaatgcctcgagggcgtgtgccacatttccctgctgacgtaaaacacctggccagcaggaccggcttccggcaaagacccgcgcaaaccatgtcttgctgtttgacttacttaggaatgaggatgaccctgtattcctgggttagtcaaggtcagcttgccagagacggaggagggcgggggggccgtgaccctctagactgggaggaccaccaggagaggcactgggggctgcggccgggtgggcagatgccgccgtggctccatccatcagcacccagtcctttgcttcactgtgctctggccaagcgcgtgcgacttcctgtcacaccttaggcctgagcgcttattaagaaaacagtatgaaaaatgacaaacactcctgtccacagtctgagaatcccaagtgtctcaacacggtaccagaagtaccacctgggagcagcactggctatcttgggtcagggacacacaagcttgaacgtggcctcttagaggagctcgatgtcagatatgtaaacactggcacaagaaaatccagacactaagcattcaccgtgtcaattctgagacaggaaacaccgcccagagtgaggagcctgcgcagcccggggcccaggaggagaggccttcactcgcatgtcagtgtctcatctgggaccacagctgtgatgttctgctgtgcaatatgggtcacctttcgaaaaggccaaacaaaaggtgggctttcctgtgtccagcgactgccatgttttaggtaaagactttagtaaaggtggaggtaaaatcacttggtaaaacgttgagagtatttcttttctcgaatcaaaaacgctgacatgcaagtgggttccgcctctcccgcagtggggggccgagtgctgaacctacaaagccagtctgctccctgccagcttcgctgcccctcatggagggttgcatgaggacagatttaaattaaaaacaaaacactctacgtatcaaagaaatgtgtcaaaataatctcaaacaattaaaatataatatatatttataattccgggccctcaaagcaatcatggtagttaagaaccaagttttgagtcattaggatagaggccaactttaaacatctccagtgagatggaattaggaaactggca

SEQ ID NO: 358037 - DNA, 2994 bp, Homo sapiens
agcgggtcatcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacgctgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaatgtgggtacgttactaacacaagatggaacttgagatttcctgaagcgcagtgttaaaatgcctcgagggcgtgtgccacatttccctgctgacgtaaaacacctggccagcaggaccggcttccggcaaagacccgcgcaaaccatgtcttgctgtttgacttacttaggaatgaggatgaccctgtattcctgggttagtcaaggtcagcttgccagagacggaggagggcgggggggccgtgaccctctagactgggaggaccaccaggagaggcactgggggctgcggccgggtgggcagatgccgccgtggctccatccatcagcacccagtcctttgcttcactgtgctctggccaagcgcgtgcgacttcctgtcacaccttaggcctgagcgcttattaagaaaacagtatgaaaaatgacaaacactcctgtccacagtctgagaatcccaagtgtctcaacacggtaccagaagtaccacctgggagcagcactggctatcttgggtcagggacacacaagcttgaacgtggcctcttagaggagctcgatgtcagatatgtaaacactggcacaagaaaatccagacactaagcattcaccgtgtcaattctgagacaggaaacaccgcccagagtgaggagcctgcgcagcccggggcccaggaggagaggccttcactcgcatgtcagtgtctcatctgggaccacagctgtgatgttctgctgtgcaatatgggtcacctttcgaaaaggccaaacaaaaggtgggctttcctgtgtccagcgactgccatgttttaggtaaagactttagtaaaggtggaggtaaaatcacttggtaaaacgttgagagtatttcttttctcgaatcaaaaacgctgacatgcaagtgggttccgcctctcccgcagtggggggccgagtgctgaacctacaaagccagtctgctccctgccagcttcgctgcccctcatggagggttgcatgaggacagatttaaattaaaaacaaaacactctacgtatcaaagaaatgtgtcaaaataatctcaaacaattaaaatataatatatatttataattccgggccctcaaagcaatcatggtagttaagaaccaagttttgagtcattaggatagaggccaactttaaacatctccagtgagatggaattaggaaactggca

SEQ ID NO: 358038 - DNA, 2866 bp, Homo sapiens
agcgggtcatcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacgctgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacacacaccttcaatacacgtcaaggtcgcttccagttttagaaaacagaaatctgcatctcagcctgagacgcacagagaggtctcttcctgacccagacgcactcacgagccaggtccatttaacctgcgccagagagttcaccgtaggcatctttaataaactaactccagcaaaatgtgggtacgttactaacacaagatggaacttgagatttcctgaagcgcagtgttaaaatgcctcgagggcgtgtgccacatttccctgctgacgtaaaacacctggccagcaggaccggcttccggcaaagacccgcgcaaaccatgtcttgctgtttgacttacttaggaatgaggatgaccctgtattcctgggttagtcaaggtcagcttgccagagacggaggagggcgggggggccgtgaccctctagactgggaggaccaccaggagaggcactgggggctgcggccgggtgggcagatgccgccgtggctccatccatcagcacccagtcctttgcttcactgtgctctggccaagcgcgtgcgacttcctgtcacaccttaggcctgagcgcttattaagaaaacagtatgaaaaatgacaaacactcctgtccacagtctgagaatcccaagtgtctcaacacggtaccagaagtaccacctgggagcagcactggctatcttgggtcagggacacacaagcttgaacgtggcctcttagaggagctcgatgtcagatatgtaaacactggcacaagaaaatccagacactaagcattcaccgtgtcaattctgagacaggaaacaccgcccagagtgaggagcctgcgcagcccggggcccaggaggagaggccttcactcgcatgtcagtgtctcatctgggaccacagctgtgatgttctgctgtgcaatatgggtcacctttcgaaaaggccaaacaaaaggtgggctttcctgtgtccagcgactgccatgttttaggtaaagactttagtaaaggtggaggtaaaatcacttggtaaaacgttgagagtatttcttttctcgaatcaaaaacgctgacatgcaagtgggttccgcctctcccgcagtggggggccgagtgctgaacctacaaagccagtctgctccctgccagcttcgctgcccctcatggagggttgcatgaggacagatttaaattaaaaacaaaacactctacgtatcaaagaaatgtgtcaaaataatctcaaacaattaaaatataatatatatttataattccgggccctcaaagcaatcatggtagttaagaaccaagttttgagtcattaggatagaggccaactttaaacatctccagtgagatggaattaggaaactggca

SEQ ID NO: 358039 - DNA, 2886 bp, Homo sapiens
agcgggtcatcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacgctgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaatgtgggtacgttactaacacaagatggaacttgagatttcctgaagcgcagtgttaaaatgcctcgagggcgtgtgccacatttccctgctgacgtaaaacacctggccagcaggaccggcttccggcaaagacccgcgcaaaccatgtcttgctgtttgacttacttaggaatgaggatgaccctgtattcctgggttagtcaaggtcagcttgccagagacggaggagggcgggggggccgtgaccctctagactgggaggaccaccaggagaggcactgggggctgcggccgggtgggcagatgccgccgtggctccatccatcagcacccagtcctttgcttcactgtgctctggccaagcgcgtgcgacttcctgtcacaccttaggcctgagcgcttattaagaaaacagtatgaaaaatgacaaacactcctgtccacagtctgagaatcccaagtgtctcaacacggtaccagaagtaccacctgggagcagcactggctatcttgggtcagggacacacaagcttgaacgtggcctcttagaggagctcgatgtcagatatgtaaacactggcacaagaaaatccagacactaagcattcaccgtgtcaattctgagacaggaaacaccgcccagagtgaggagcctgcgcagcccggggcccaggaggagaggccttcactcgcatgtcagtgtctcatctgggaccacagctgtgatgttctgctgtgcaatatgggtcacctttcgaaaaggccaaacaaaaggtgggctttcctgtgtccagcgactgccatgttttaggtaaagactttagtaaaggtggaggtaaaatcacttggtaaaacgttgagagtatttcttttctcgaatcaaaaacgctgacatgcaagtgggttccgcctctcccgcagtggggggccgagtgctgaacctacaaagccagtctgctccctgccagcttcgctgcccctcatggagggttgcatgaggacagatttaaattaaaaacaaaacactctacgtatcaaagaaatgtgtcaaaataatctcaaacaattaaaatataatatatatttataattccgggccctcaaagcaatcatggtagttaagaaccaagttttgagtcattaggatagaggccaactttaaacatctccagtgagatggaattaggaaactggca

SEQ ID NO: 358040 - DNA, 1713 bp, Homo sapiens
  misc_feature (1693)..(1693): n is a, c, g, or t
agcgggtcatcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacgctgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccacaggggaacctttttttgggggaaaatttggggaaaaaaccccccccaaaacccccaaaaaacaccccctggggggggggggggggggggggncccccccaaaaaaaaatttt

SEQ ID NO: 358041 - DNA, 1648 bp, Homo sapiens
attcgcggccgcgtcgaccaagtcctgggggatgtgctctgcccagggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaatgtgggtacgttactaacacaagatggaacttgagatttcctgaagcgcagtgttaaaatgcctcgagggcgtgtgccacatttccctgctgacgtaaaacacctggccagcaggaccggcttccggcaaagacccgcgcaaaccatgtcttgctgtttgacttacttaggaatgaggatgaccctgtattcctgggttagtcaaggtcagcttgccagagacggaggagggcgggggggccgtgaccctctagactgggaggaccaccaggagaggcactgggggctgcggccgggtgggcagatgccgccgtggctccatccatcagcacccagtcctttgcttcactgtgctctggccaagcgcgtgcgacttcctgtcacaccttaggcctgagcgcttattaagaaaacagtatgaaaaatgacaaacactcctgtccacagtctgagaatcccaagtgtctcaacacggtaccagaagtaccacctgggagcagcactggctatcttgggtcagggacacacaagcttgaacgtggcctcttagaggagctcgatgtcagatatgtaaacactggcacaagaaaatccagacactaagcattcaccgtgtcaattctgagacaggaaacaccgcccagagtgaggagcctgcgcagcccggggcccaggaggagaggccttcactcgcatgtcagtgtctcatctgggaccacagctgtgatgttctgctgtgcaatatgggtcacctttcgaaaaggccaaacaaaaggtgggctttcctgtgtccagcgactgccatgttttaggtaaagactttagtaaaggtggaggtaaaatcacttggtaaaacgttgagagtatttcttttctcgaatcaaaaacgctgacatgcaagtgggttccgcctctcccgcagtggggggccgagtgctgaacctacaaagccagtctgctccctgccagcttcgctgcccctcatggagggttgcatgaggacagatttaaattaaaaacaaaacactctacgtatcaaagaaatgtgtcaaaataatctcaaacaattaaaatataatatatatttataattccgggccctcaaagcaatcatggtagttaagaaccaagttttgagtcattaggatagaggccaactttaaacatctccagtgagatggaattaggaaactggca

SEQ ID NO: 358042 - DNA, 3262 bp, Homo sapiens
agcgggtcatcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacgctgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtaccaggcgctgaggccagatcccctcagggtcctgatgagtgtggcgccatctgccttacagctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaatgtgggtacgttactaacacaagatggaacttgagatttcctgaagcgcagtgttaaaatgcctcgagggcgtgtgccacatttccctgctgacgtaaaacacctggccagcaggaccggcttccggcaaagacccgcgcaaaccatgtcttgctgtttgacttacttaggaatgaggatgaccctgtattcctgggttagtcaaggtcagcttgccagagacggaggagggcgggggggccgtgaccctctagactgggaggaccaccaggagaggcactgggggctgcggccgggtgggcagatgccgccgtggctccatccatcagcacccagtcctttgcttcactgtgctctggccaagcgcgtgcgacttcctgtcacaccttaggcctgagcgcttattaagaaaacagtatgaaaaatgacaaacactcctgtccacagtctgagaatcccaagtgtctcaacacggtaccagaagtaccacctgggagcagcactggctatcttgggtcagggacacacaagcttgaacgtggcctcttagaggagctcgatgtcagatatgtaaacactggcacaagaaaatccagacactaagcattcaccgtgtcaattctgagacaggaaacaccgcccagagtgaggagcctgcgcagcccggggcccaggaggagaggccttcactcgcatgtcagtgtctcatctgggaccacagctgtgatgttctgctgtgcaatatgggtcacctttcgaaaaggccaaacaaaaggtgggctttcctgtgtccagcgactgccatgttttaggtaaagactttagtaaaggtggaggtaaaatcacttggtaaaacgttgagagtatttcttttctcgaatcaaaaacgctgacatgcaagtgggttccgcctctcccgcagtggggggccgagtgctgaacctacaaagccagtctgctccctgccagcttcgctgcccctcatggagggttgcatgaggacagatttaaattaaaaacaaaacactctacgtatcaaagaaatgtgtcaaaataatctcaaacaattaaaatataatatatatttataattccgggccctcaaagcaatcatggtagttaagaaccaagttttgagtcattaggatagaggccaactttaaacatctccagtgagatggaattaggaaactggca

SEQ ID NO: 358043 - DNA, 2565 bp, Homo sapiens
  misc_feature (1)..(1): n is a, c, g, or t
naacctaggctaggtcgaggccgggtggttggatcacgtactccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaatgtgggtacgttactaacacaagatggaacttgagatttcctgaagcgcagtgttaaaatgcctcgagggcgtgtgccacatttccctgctgacgtaaaacacctggccagcaggaccggcttccggcaaagacccgcgcaaaccatgtcttgctgtttgacttacttaggaatgaggatgaccctgtattcctgggttagtcaaggtcagcttgccagagacggaggagggcgggggggccgtgaccctctagactgggaggaccaccaggagaggcactgggggctgcggccgggtgggcagatgccgccgtggctccatccatcagcacccagtcctttgcttcactgtgctctggccaagcgcgtgcgacttcctgtcacaccttaggcctgagcgcttattaagaaaacagtatgaaaaatgacaaacactcctgtccacagtctgagaatcccaagtgtctcaacacggtaccagaagtaccacctgggagcagcactggctatcttgggtcagggacacacaagcttgaacgtggcctcttagaggagctcgatgtcagatatgtaaacactggcacaagaaaatccagacactaagcattcaccgtgtcaattctgagacaggaaacaccgcccagagtgaggagcctgcgcagcccggggcccaggaggagaggccttcactcgcatgtcagtgtctcatctgggaccacagctgtgatgttctgctgtgcaatatgggtcacctttcgaaaaggccaaacaaaaggtgggctttcctgtgtccagcgactgccatgttttaggtaaagactttagtaaaggtggaggtaaaatcacttggtaaaacgttgagagtatttcttttctcgaatcaaaaacgctgacatgcaagtgggttccgcctctcccgcagtggggggccgagtgctgaacctacaaagccagtctgctccctgccagcttcgctgcccctcatggagggttgcatgaggacagatttaaattaaaaacaaaacactctacgtatcaaagaaatgtgtcaaaataatctcaaacaattaaaatataatatatatttataattccgggccctcaaagcaatcatggtagttaagaaccaagttttgagtcattaggatagaggccaactttaaacatctccagtgagatggaattaggaaactggca

SEQ ID NO: 358044 - DNA, 1648 bp, Homo sapiens
agcgggtcatcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacgctgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccagcctatttcccgcctccatttgatgtttccaggttttcaaaactgcatttaacctgcgccagagagttcaccgtaggcatctttaataaactaactccag

SEQ ID NO: 358045 - DNA, 1109 bp, Homo sapiens
agcgggtcatcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacgctgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtaccaggcgctgaggccagatcccctcagggtcctgatgagtgtggcgccatctgccttacagctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggtgaggtgggagcctgctgccgtcctggggtggtcagcggctgtgccggcaagatgcacc

SEQ ID NO: 358046 - DNA, 339 bp, Homo sapiens
ctgggagtacaggcgtgaaccacagcgcccagctgtagttgggtgtttaacagtaacaaatgtgtggacagccgccacccccagggacagtggcgacaggacagcatgcgaacctatgaacgggaagccctgaagaaaaagtttacgcgagtccatgatgcggagtcctccgatgaagacggctatgactggggtccggccactgacctgtgacctctcgcaggctgccagctggtccgtcctccttctccctccctggggctgggactcagtttcccatacagaacccacaaccttacctccctccgcctggtctttaataaacagagtattttcaca

SEQ ID NO: 358047 - DNA, 1378 bp, Homo sapiens
tgctgacctatgagttagctaggttcaactgctaaaaagagaccctacagccaggaagaaagggaatgaaggcaggagaggggcttattcctgcccttgaaggcggaacccagaaatgtacacatcaattctgctagtgttccattggccattatttggtcataaggctaacctagctgcaaaggacactgggagatgtagtatttggctgggtagctatggtcctggttaaataggctgtttactataaggaagtggaggggtttgtacaacacactagcagtctttgatcgcaaatgggaccctgattctttcactgtgtctctacccctcagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttacgcgagtccatgatgcggagtcctccgatgaagacggctatgactggggtccggccactgacctgtgacctctcgcaggctgccagctggtccgtcctccttctccctccctggggctgggactcagtttcccatacagaacccacaaccttacctccctccgcctggtctttaataaacagagtattttcaca

SEQ ID NO: 358048 - DNA, 725 bp, Homo sapiens
ttccgcctcaggacctggctcctgtgatgggaggtggggagagaaacctccgccgcgtccagggggcgtgtctgggcaggggcggggctgacccgagacctggaggaggaagaggggcaggtgcagccgggagctgcggagctggagggaggaggacgagagcccggccctcagcccgctgtgactctcctcagccccctcccccagcccggggtgggggccgattgactgtttccaggaccccctcgggtaggggggctggagagcccccaggtggaccatggcggtgagattccaggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcgtgagtaggcagcccctggcatggccagcatctctgaccccagcctgggtcgtgccgctgtgggggttgtaagcttctgagagcaaggagtcatcttctcatcttacagtttggacattgaggcccagagagagactggtgtcccccagggccaccc

SEQ ID NO: 358049 - DNA, 2380 bp, Homo sapiens
ggtcttccacgtgctggacacgctgcaccccggccccgggcagagccacgcacgaggaggccactggcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagcggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttacgcgagtccatgatgcggagtcctccgatgaagacggctatgactggggtccggccactgacctgtgacctctcgcaggctgccagctggtccgtcctccttctccctccctggggctgggactcagtttcccatacagaacccacaaccttacctccctccgcctggtctttaataaacagagtattttcaca

SEQ ID NO: 358050 - DNA, 3193 bp, Homo sapiens
ttccgcctcaggacctggctcctgtgatgggaggtggggagagaaacctccgccgcgtccagggggcgtgtctgggcaggggcggggctgacccgagacctggaggaggaagaggggcaggtgcagccgggagctgcggagctggagggaggaggacgagagcccggccctcagcccgctgtgactctcctcagccccctcccccagcccggggtgggggccgattgactgtttccaggaccccctcgggtaggggggctggagagcccccaggtggaccatggcggtgagattccaggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagcggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttacgcgagtccatgatgcggagtcctccgatgaagacggctatgactggggtccggccactgacctgtgacctctcgcaggctgccagctggtccgtcctccttctccctccctggggctgggactcagtttcccatacagaacccacaaccttacctccctccgcctggtctttaataaacagagtattttcaca

SEQ ID NO: 358051 - DNA, 1850 bp, Homo sapiens
cccctcaccctggtccgtctccctgtgtctgtggtcgtcagttccactggcaggggacctgcctccctgttgccaccacaagagaggaaaagttggtcaaacaggtggggaggccagagctacaagcctcgggttccctccccaccacccgtgccaggcaggcacccgggccctggcacctgctgcctgcccagaggccacccagcctcctagacaggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttacgcgagtccatgatgcggagtcctccgatgaagacggctatgactggggtccggccactgacctgtgacctctcgcaggctgccagctggtccgtcctccttctccctccctggggctgggactcagtttcccatacagaacccacaaccttacctccctccgcctggtctttaataaacagagtattttcaca

SEQ ID NO: 358052 - DNA, 234 bp, Homo sapiens
ccagtttcaagcgcccggtagtgatcctgggacccgtggccgacattgctatgcagaagttgactgctgagatgcctgaccagtttgaaatcgcaggtgagaagccagatcctctggaaacctcgttggtgaaatagtttcacaactgtttttttgtggggggtcgggggagagttagaataatgatggcaaacatgaagcagatgggccaccagtgccccccccaatacccaa

SEQ ID NO: 358053 - DNA, 2985 bp, Homo sapiens
atgaacctgtgtggcctcatgcccatcttccccgctcccctcgaccaggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggaaggcgtgaccatggctgatgagatgtcctctccccctgcagacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagcggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttacgcgagtccatgatgcggagtcctccgatgaagacggctatgactggggtccggccactgacctgtgacctctcgcaggctgccagctggtccgtcctccttctccctccctggggctgggactcagtttcccatacagaacccacaaccttacctccctccgcctggtctttaataaacagagtattttcaca

SEQ ID NO: 358054 - DNA, 411 bp, Homo sapiens
gcagacttgtcacggggttagcaagtgggcagcatggcccgggccaaggtgggggatgggatggaggtggttattgatctcgactcaccatgctctggggggagttttgaagctcctctctccctctcctccaaggtggacagccgccacccccagggacagtggcgacaggacagcatgcgaacctatgaacgggaagccctgaagaaaaagtttacgcgagtccatgatgcggagtcctccgatgaagacggctatgactggggtccggccactgacctgtgacctctcgcaggctgccagctggtccgtcctccttctccctccctggggctgggactcagtttcccatacagaacccacaaccttacctccctccgcctggtctttaataaacagagtattttcaca

SEQ ID NO: 358055 - DNA, 3112 bp, Homo sapiens
cccctcaccctggtccgtctccctgtgtctgtggtcgtcagttccactggcaggggacctgcctccctgttgccaccacaagagaggaaaagttggtcaaacaggtggggaggccagagctacaagcctcgggttccctccccaccacccgtgccaggcaggcacccgggccctggcacctgctgcctgcccagaggccacccagcctcctagacaggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagcggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttacgcgagtccatgatgcggagtcctccgatgaagacggctatgactggggtccggccactgacctgtgacctctcgcaggctgccagctggtccgtcctccttctccctccctggggctgggactcagtttcccatacagaacccacaaccttacctccctccgcctggtctttaataaacagagtattttcaca

SEQ ID NO: 358056 - DNA, 1259 bp, Homo sapiens
gctgcatagtgcagctgtgctattacgtccaggagggacgtgtgaatcatgtcgactactgcaccgtgcacgaactgatgatcgcgacgacgaatgccgaatgttggtccgtgggtcgttgatgcttgaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttacgcgagtccatgatgcggagtcctccgatgaagacggctatgactggggtccggccactgacctgtgacctctcgcaggctgccagctggtccgtcctccttctccctccctggggctgggactcagtttcccatacagaacccacaaccttacctccctccgcctggtctttaataaacagagtattttcaca

SEQ ID NO: 358057 - DNA, 377 bp, Homo sapiens
attgaaacaatgatgatgttatgagcaatagaatgcccttagcctgtgcatggcaacatcacgagtggcacggtgacctggtgtccccgccccgtggagatgtcattgacacaatcagatctcgggtcctacgggcgacatcactgttctccttatgatgccatcaaggtgttaggatgggagggcccgcacctggactgcttacagcaggagaatgctcccaggcacccgtctccagagtcctgcctcagtttccctcctccccccttacagagtttggcgtcaagctgggcagtcagatcttcatcaagcacattacagattcgggcctggctgcccggcaccgtgggctgcaggaaggagatctcattctacag

SEQ ID NO: 358058 - DNA, 543 bp, Homo sapiens
atatcatgcagacctgtctgcaagctgaggagcaaggaagccagtcagagtcccaaagctgaagaacttggagtctgatgtttgagggcaggaagcattcagcacaggagaaggatgtaggctgggaggctaagccagtttagccttttcacatttttctgcctgctttatatcttggctgtgctggcagctgattagatggtgcccacctagattaagggtgggtctgcctttcccagcccactgactcaaatgttaatctccttcggcaacaccctcacagacacacccaggatcaatactttgcatccttcaatcaagttgacactcattattaaccatcacaatacccatatatatacacacttctagaattatttctttgtctacccatctatatttatattcagctaagcatgaattaatactaatgtctccaactgtaatccagctccatgagattcattctagccttccctccactattgtcctatgaccctgccaaatccccctctgtgaaaaacacccaagaatgatcaatta

SEQ ID NO: 358059 - DNA, 3097 bp, Homo sapiens
tccaggaatcgatagtgcattcgtgcgcgcggccgcccgtcgcttcgcacagggctggatggttgtattgggcagggtggctccaggatgttaggaactgtgaagatggaagggcatgaaaccagcgactggaacagctactacgcagacacgcaggaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgaatggcctgggcccctacgcggccgccatgaacccgtgcatgagccccatggcgtacgcgccgtccaacctgggccgcagccgcgcgggcggcggcggcgacgccaagacgttcaagcgcagctacccgcacgccaagccgccctactcgtacatctcgctcatcaccatggccatccagcaggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggcccccgggcccggccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgttcggtttatactgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacatgatacattctcaagagttgcttgaccgaaagttacaaggaccccaacccctttgtcctctctacccacagatggccctgggaatcaattcctcaggaattgccctcaagaactctgcttcttgctttgcagagtgccatggtcatgtcattctgaggtcacataacacataaaattagtttctatgagtgtataccatttaaagaatttttttttcagtaaaagggaatattacaatgttggaggagagataagttatagggagctggatttcaaaacgtggtccaagattcaaaaatcctattgatagtggccattttaatcattgccatcgtgtgcttgtttcatccagtgttatgcactttccacagttggacatggtgttagtatagccagacgggtttcattattatttctctttgctttctcaatgttaatttattgcatggtttattctttttctttacagctgaaattgctttaaatgatggttaaaattacaaattaaattgttaatttttatcaatgtgattgtaattaaaaatattttgatttaaataacaaaaataataccagattttaagccgtggaaaatgttcttgatcatttgcagttaaggactttaaataaatcaaatgttaacaaaaaacatttctgttattttttttcacttaactaaatccgaagtgaatatttctgaatacgatatttttcaaattctagaactgaatataaatgacaaaaatgaaaataaaattgttttgtctgttgttataatgaatgtgtagctagtaaaaaggagtgaaagaaattcaagtaaagtgtataagttgatttaatattccaagagttga

SEQ ID NO: 358060 - DNA, 1589 bp, Homo sapiens
ctactactactaaattcgcggccgcgtcgaccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgttcggtttatactgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacatgatacattctcaagagttgcttgaccgaaagttacaaggaccccaacccctttgtcctctctacccacagatggccctgggaatcaattcctcaggaattgccctcaagaactctgcttcttgctttgcagagtgccatggtcatgtcattctgaggtcacataacacataaaattagtttctatgagtgtataccatttaaagaatttttttttcagtaaaagggaatattacaatgttggaggagagataagttatagggagctggatttcaaaacgtggtccaagattcaaaaatcctattgatagtggccattttaatcattgccatcgtgtgcttgtttcatccagtgttatgcactttccacagttggacatggtgttagtatagccagacgggtttcattattatttctctttgctttctcaatgttaatttattgcatggtttattctttttctttacagctgaaattgctttaaatgatggttaaaattacaaattaaattgttaatttttatcaatgtgattgtaattaaaaatattttgatttaaataacaaaaataataccagattttaagccgtggaaaatgttcttgatcatttgcagttaaggactttaaataaatcaaatgttaacaaaaaacatttctgttattttttttcacttaactaaatccgaagtgaatatttctgaatacgatatttttcaaattctagaactgaatataaatgacaaaaatgaaaataaaattgttttgtctgttgttataatgaatgtgtagctagtaaaaaggagtgaaagaaattcaagtaaagtgtataagttgatttaatattccaagagttga

SEQ ID NO: 358061 - DNA, 1822 bp, Homo sapiens
tccaggaatcgatagtgcattcgtgcgcgcggccgcccgtcgcttcgcacagggctggatggttgtattgggcagggtggctccaggatgttaggaactgtgaagatggaagggcatgaaaccagcgactggaacagctactacgcagacacgcaggaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgaatggcctgggcccctacgcggccgccatgaacccgtgcatgagccccatggcgtacgcgccgtccaacctgggccgcagccgcgcgggcggcggcggcgacgccaagacgttcaagcgcagctacccgcacgccaagccgccctactcgtacatctcgctcatcaccatggccatccagcaggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggcccccgggcccggccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgaagcagcaaacatatcctacacaaacgcctgagccctactaataacattaattgccacatccctaatccgctgcctacagcactcgaattatctatttgatccctagggcaaccacgtttcccacgcctgttc

SEQ ID NO: 358062 - DNA, 557 bp, Homo sapiens
ctactactactaaattcgcggccgcgtcgattttttttttttgacaccggcttaagccttctgtgtttcctttgagccttttcactacaaaatcaaatattaatttaactacctttcctccttccccaatgtatcacttttctttatctgagaattcttccaatgaaaataaaatatcagctgtggctgatagaattaagttgtgtccaacggagactcatgaactctcttctcattaaaagagaaacgaaacttagccatcagggtagctctggaggaggtgggaggaggggagttaattcactctcgcaggggaagcgttgtaccgacaggacattttagggtagccgctattttgcattttgtgaagattgttttaaattttgattcaaaaatgtcgttcctaagaacttaaagttgataatttgtttccttctaaggagctcttaaatgcaacttcacactccatagttgcttgggatcacaaaatcattaatctcctttgatagcaggctcactttccagtccacctatttctttgtaagtctgtacggatt

SEQ ID NO: 358063 - DNA, 651 bp, Homo sapiens
tgctctagaggatccttatggctgttactaaatggctgttacctaaatggcgttacctaaatggctgttacctaaatggctgttacctaaatggctgtacctaaatggctgttacctaaatggctgcatcgtgtgcttgtttcatccagtgttatgcactttccacagttggacatggtgttagtatagccagacgggtttcattattatttctctttgctttctcaatgttaatttattgcatggtttattctttttctttacagctgaaattgctttaaatgatggttaaaattacaaattaaattgttaatttttatcaatgtgattgtaattaaaaatattttgatttaaataacaaaaataataccagattttaagccgtggaaaatgttcttgatcatttgcagttaaggactttaaataaatcaaatgttaacaaaaaacatttctgttattttttttcacttaactaaatccgaagtgaatatttctgaatacgatatttttcaaattctagaactgaatataaatgacaaaaatgaaaataaaattgttttgtctgttgttataatgaatgtgtagctagtaaaaaggagtgaaagaaattcaagtaaagtgtataagttgatttaatattccaagagttga

SEQ ID NO: 358064 - DNA, 1778 bp, Homo sapiens
catatcgagctcggcccggattataaaccgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgttcggtttatactgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacatgatacattctcaagagttgcttgaccgaaagttacaaggaccccaacccctttgtcctctctacccacagatggccctgggaatcaattcctcaggaattgccctcaagaactctgcttcttgctttgcagagtgccatggtcatgtcattctgaggtcacataacacataaaattagtttctatgagtgtataccatttaaagaatttttttttcagtaaaagggaatattacaatgttggaggagagataagttatagggagctggatttcaaaacgtggtccaagattcaaaaatcctattgatagtggccattttaatcattgccatcgtgtgcttgtttcatccagtgttatgcactttccacagttggacatggtgttagtatagccagacgggtttcattattatttctctttgctttctcaatgttaatttattgcatggtttattctttttctttacagctgaaattgctttaaatgatggttaaaattacaaattaaattgttaatttttatcaatgtgattgtaattaaaaatattttgatttaaataacaaaaataataccagattttaagccgtggaaaatgttcttgatcatttgcagttaaggactttaaataaatcaaatgttaacaaaaaacatttctgttattttttttcacttaactaaatccgaagtgaatatttctgaatacgatatttttcaaattctagaactgaatataaatgacaaaaatgaaaataaaattgttttgtctgttgttataatgaatgtgtagctagtaaaaaggagtgaaagaaattcaagtaaagtgtataagttgatttaatattccaagagttga

SEQ ID NO: 358065 - DNA, 2886 bp, Homo sapiens
tccaggaatcgatagtgcattcgtgcgcgcggccgcccgtcgcttcgcacagggctggatggttgtattgggcagggtggctccaggatgttaggaactgtgaagatggaagggcatgaaaccagcgactggaacagctactacgcagacacgcaggaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgaatggcctgggcccctacgcggccgccatgaacccgtgcatgagccccatggcgtacgcgccgtccaacctgggccgcagccgcgcgggcggcggcggcgacgccaagacgttcaagcgcagctacccgcacgccaagccgccctactcgtacatctcgctcatcaccatggccatccagcaggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggcccccgggcccggccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgttcggtttatactgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacatgatacattctcaagagttgcttgaccgaaagttacaaggaccccaacccctttgtcctctctacccacagatggccctgggaatcaattcctcaggaattgccctcaagaactctgcttcttgctttgcagagtgccatggtcatgtcattctgaggtcacataacacataaaattagtttctatgagtgtataccatttaaagaatttttttttcagtaaaagggaatattacaatgttggaggagagataagttatagggagctggatttcaaaacgtggtccaagattcaaaaatcctattgatagtggccattttaatcattgccatcgtgtgcttgtttcatccagtgttatgcactttccacagttggacatggtgttagtatagccagacgggtttcattattatttctctttgctttctcaatgttaatttattgcatggtttattctttttctttacagctgaaattgctttaaatgatggttaaaattacaaattaaattgttaatttttatcaatgtgattgtaattaaaaatattttgatttaaataacaaaaataataccagattttaagccgtggaaaatgttcttgatcatttgcagttaaggactttaaataaatcaaatgttaac

SEQ ID NO: 358066 - DNA, 1630 bp, Homo sapiens
gtctatctaacaggtcctccccaagactcaagaaggagactaactccgccatcagcacccaaagctgaaattctaactaaactattccctgcaaccaaaacaagcattccattcgtatcaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgttcggtttatactgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacatgatacattctcaagagttgcttgaccgaaagttacaaggaccccaacccctttgtcctctctacccacagatggccctgggaatcaattcctcaggaattgccctcaagaactctgcttcttgctttgcagagtgccatggtcatgtcattctgaggtcacataacacataaaattagtttctatgagtgtataccatttaaagaatttttttttcagtaaaagggaatattacaatgttggaggagagataagttatagggagctggatttcaaaacgtggtccaagattcaaaaatcctattgatagtggccattttaatcattgccatcgtgtgcttgtttcatccagtgttatgcactttccacagttggacatggtgttagtatagccagacgggtttcattattatttctctttgctttctcaatgttaatttattgcatggtttattctttttctttacagctgaaattgctttaaatgatggttaaaattacaaattaaattgttaatttttatcaatgtgattgtaattaaaaatattttgatttaaataacaaaaataataccagattttaagccgtggaaaatgttcttgatcatttgcagttaaggactttaaataaatcaaatgttaacaaaaaacatttctgttattttttttcacttaactaaatccgaagtgaatatttctgaatacgatatttttcaaattctagaactgaatataaatgacaaaaatgaaaataaaattgttttgtctgttgttataatgaatgtgtagctagtaaaaaggagtgaaagaaattcaagtaaagtgtataagttgatttaatattccaagagttga

SEQ ID NO: 358067 - DNA, 447 bp, Homo sapiens
gcgtcccgtgttctgcaaagtgctctgcacttgcccccgggttaggtcccggacggccgccctccagtgcccaccactaaccccgccctccggggcttcttcactcgctgtctccactccaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgaatggcctgggcccctacgcggccg

SEQ ID NO: 358068 - DNA, 2876 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaaaatttctc

SEQ ID NO: 358069 - DNA, 2892 bp, Homo sapiens
cacccctgggcttggcctgccttgccctgccgggaagtgatccccaaggcagggtgagagttccccatctgaggcgtttgttgcagctacctgcacttctagatgctccccaggttcatcctgtgtcgtctcccccacctaccagtctcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctg

SEQ ID NO: 358070 - DNA, 2782 bp, Homo sapiens
ggctaggtcgagctgggtgtgaatcggccgaggtggctcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctg

SEQ ID NO: 358071 - DNA, 2809 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaaaatttctc

SEQ ID NO: 358072 - DNA, 2856 bp, Homo sapiens
tcgacttagaggacccgctcttgtttcctgcacttctagatgctccccaggttcatcctgtgtcgtctcccccacctaccagtctcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaaaatttctc

SEQ ID NO: 358073 - DNA, 2889 bp, Homo sapiens
  misc_feature (213)..(213): n is a, c, g, or t
  misc_feature (372)..(372): n is a, c, g, or t
cttcttgatgatatcctgggactgtagggacgtcaccaatggcgatctgaggatgtcatgattccgcgtgcccccattccatgtatctccattgtagactgtaccacaaagagcagacgtgtccgatgtggaggtcggggcaaagatgctacactccgggaatcgtacagattgaagggtaggctactgcttttggtgccgccagtgtgcacnaatgagatggagcagatccacctcaccactgactcagacagtacttgcaacgagctggtcacagagactcacatgtagttcatcgtgtgtatgacgcctgagtggtcattggtgtgtctgatcttgaactgtgtcactagtggctagagttgcgtgtgnatcagctcactgctgtacctgcagataattcactggcatgacaccaatagtacactcacttcacgcgcacgtgtaaccgcatagggcaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaaaatttctc

SEQ ID NO: 358074 - DNA, 2412 bp, Homo sapiens
ttgaaagctgttgagggccacccactgctcttccttccccacccccgcttcatgctgtttccacttgggctggaaaatgtgaccatgaccatgcggatgtggcttttccttccctcaccttcaccatgagctgtgggcagtggccatgacttacctgattctggatcaacaaagaagacgttcaaatacaattgacaaatgtaggccaataggtacagtggctcacacctgtcatcccagcactttgccaaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaaaatttctc

SEQ ID NO: 358075 - DNA, 1789 bp, Homo sapiens
acgtcgtcggtaccgacgctctctctgtgggatgaggaaactgaagcccaaggggtgaggtagttagcccacgatgacagggccagcagatggcaaacctggggtggagcctggcctccccgtagagaaggtgtttaacctcgtggcgcgccttccctggatgggctctgctttgggacagctgggcggatcttcctcccttccacccttacgggcagcttccctccctgtcctcgtcccaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaaaatttctc

SEQ ID NO: 358076 - DNA, 2626 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctg

SEQ ID NO: 358077 - DNA, 1137 bp, Homo sapiens
gcagcttccccattctgggcctgtttgttcacaggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaaaatttctc

SEQ ID NO: 358078 - DNA, 1305 bp, Homo sapiens
tacgactcgagctagtaccctcggataaggggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaaaatttctc

SEQ ID NO: 358079 - DNA, 2416 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctg

SEQ ID NO: 358080 - DNA, 2187 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaaataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgacatacgaacaaccccacaaag

SEQ ID NO: 358081 - DNA, 1350 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaagctcaagagacagctatcggg

SEQ ID NO: 358082 - DNA, 1090 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcacccatccacgtagcgtcataagaccggcacggtcaatggagagtaatctctgtacttccctcctagcccgaagt

SEQ ID NO: 358083 - DNA, 1010 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggaggtggccagtgggcccagccctggggaggggatatccccccagtctgctcaggcccctcaagctcctggagacaaccacgtggtgcctgtactgcgctaactcctgattaatacaatggaagtttctg

SEQ ID NO: 358084 - DNA, 1023 bp, Homo sapiens
gcagcttccccattctgggcctgtttgttcacaggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaaaatttctc

SEQ ID NO: 358085 - DNA, 637 bp, Homo sapiens
atgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaaaagtaagtgaggctgggagctcggctgcctataatgcccatggcaggccactgctgggaagtggataacctggcatcccttgtggactgcctgctgccatccctaccctcaaagatctattccctacccaacagatcaggtgacccacttaaaatgtgaatcaggctgggcgcggtggctcatgcccgtaatcccagcactgtgagaggctgaggcaggaagatcacttgaagccaggagtttgaggctgcagtgagccatgattgcgccactgcactccagcctgggcaacaggcctgggagactgaccctgtctcaaaagaa

SEQ ID NO: 358086 - DNA, 405 bp, Homo sapiens
gtgagcaaggctcagcagctggctgaggtggaggtgaagaagttcaagcagatgacagaggccataggccccagcaccatcagggaccttgctgtggctgggcctgagatgcaggtgagagttggggaaggtgtgttggtttcaggaccaaccttgaaaccaggaaggcagagccaaggcggaaaacacaacatctggaaagattgtggggaagggaggggtgagtgacctgacccacgatgcagggacattcacacagtgtcacgctgcatcaacgtcaggcactgtactagacccagcagtgagccagagctccggaggagacaggaaatggatgggacgccagtctgacaggcatttccaaggcagtcaagcagggtggtcagatgcaggggaggtgaccct

SEQ ID NO: 358087 - DNA, 394 bp, Homo sapiens
cgcagtcaggaacttgagcctggggtcagtgctatctttttgcctatgaaatctgtcaatcccctgtgtctaagctgtgggggaggggtaggtggggagcaggctggggggcccttgtcccttaccctccactcttggcccaggggaagaatggctggtcaccacagtaggggcgtacctcccagcggtgtttgaggaggttctggatttggtggacgccgtcatccttacggaaaaggttggtgctctgggggctgtggtttaagggacctggggctagggaaccctccgagtggcagagaatggtggtagaatggcatgagagtaaaagagaagcaataattttagggtcacttaaaaaaattcagagatcagattgcctgagtattctgga

SEQ ID NO: 358088 - DNA, 2849 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctg

SEQ ID NO: 358089 - DNA, 367 bp, Homo sapiens
agttcaagcagatgcagaggcatagcccaaaggggggcccaaagcccccccccaattttcccaaaagggggggggggacaccctttgctgtggactgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctg

SEQ ID NO: 358090 - DNA, 2919 bp, Homo sapiens
cacccctgggcttggcctgccttgccctgccgggaagtgatccccaaggcagggtgagagttccccatctgaggcgtttgttgcagctacctgcacttctagatgctccccaggttcatcctgtgtcgtctcccccacctaccagtctcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaaaatttctc

SEQ ID NO: 358091 - DNA, 2809 bp, Homo sapiens
ggctaggtcgagctgggtgtgaatcggccgaggtggctcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaaaatttctc

SEQ ID NO: 358092 - DNA, 2841 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggccttaagctaggcctataacatagttcgtctacctcc

SEQ ID NO: 358093 - DNA, 2662 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcagaaaactgctccagtccctgggccattcaacgcctccgggccatacaacgcctccgggtacattacaacg

SEQ ID NO: 358094 - DNA, 2846 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacgagccaattgaaaacggagggctagagctcaataaggaataggccgatatgcggagtggggtcttggggtggagaacctcggaagcgaagggccccgatgcatggccctgcccaggccccgggaccaggctgtcttataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctg

SEQ ID NO: 358095 - DNA, 2629 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctg

SEQ ID NO: 358096 - DNA, 2493 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacgagccaattgaaaacggagggctagagctcaataaggaataggccgatatgcggagtggggtcttggggtggagaacctcggaagcgaagggccccgatgcatggccctgcccaggccccgggaccaggctgtcttataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaaaatttctc

SEQ ID NO: 358097 - DNA, 2165 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaaataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctg

SEQ ID NO: 358098 - DNA, 1241 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctg

SEQ ID NO: 358099 - DNA, 1211 bp, Homo sapiens
taggtcgaggccggtgttgatcggacgagggcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaaaatttctc

SEQ ID NO: 358100 - DNA, 347 bp, Homo sapiens
gtgggtgtgggggctgggctgtgggggatccttggggatgtgggggcctgtttggctggcatgatggtccttatcctcctccctcttcccaagcaggagtggccctcgcttgggcgatagagaggtttctctctcatttggtgtcctctttggtagtggagacctggtcccaggtcctcacacctcttctcatcttcctgcagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagat

SEQ ID NO: 358101 - DNA, 307 bp, Homo sapiens
actgtttatttatccctttctgcccccaaaccatcgcaaccactgatctttttgcttcatcgttttacctttttcagaatgtcgtatagttaaaatcacaccagatgtggccttttcagattggcttctttcacttagtatgtgcatttaaggttcctccatgtctttccatggcatgatagttcatttctttattgtgataaataatgtctcattagtgggtgtatcattgtttatgcattcatctattgaagcacatcttggttgcctgtaagctttggcaattattaataaagcctctataaac

SEQ ID NO: 358102 - DNA, 1512 bp, Homo sapiens
accctctaacagagtaatatctgtcccctctcaactgcatgctgaatactggatcctagactcttgagagctaaataaagtatatcttttagctgcagtttcatattaaaaatgaatttttaacaatctgcatatttagatgaaatattagggaatagttactaaatgtacaaaatggtataagaaatgtatgttcgtgtcctcattatactccattccataaggtagtaaaatacttgtctgtttttcttacagaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggatgcattcagtctactagcatattcagatccctggaacagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccccactcccatataagcattcaatcagtgtaacttgcaaaatgcataaacatccgacagtttgaatttatagtgttgatggaagaaatcatttttaatgtgtactgtaaaacttgaaatactcaggagctgagtgaatatgtttgttgctacttacaatcccgacctgttagtcccagtagttttgttttaacatggtctttttcaactttgtttcctgtttaactacagatgacttctgttgtagactcacaagtttaactgttgtattataacagtattacatgtcaacggtgtggttatgacctttatttatataaaaaccaaatatttagtcaatttaccgtgtcttaatttaatctttgtacaccttccatttttaagtgcttaaatgagtactatattgcaataaaatgtagtgatataattaaccagccattaaaaatttacttctaca

SEQ ID NO: 358103 - DNA, 3277 bp, Homo sapiens
gcgctccggccaacgttctctcccggcctcccgggcccgccgcctactcccgcgtctccgagctcctcaaccgccgcggtctccctgggcgcgcggcccgccgcctgcttccggggcgggcggactgggcgcctggtgccggcggccgcagcgacagcgcccccgggaagcagaggaggaaggagagaagaggtggaggtggccgcaggctgagtcgcggccgggatgtccgggcagccgccgccgccgccgccgcagcagcagcaacagcagcagcagctgtcgccgccaccgccggcggccttggccccagtctccggagtcgtcctgccggcgcccccggccgtcagcgccggctcttctccggccggctcgcccggcggcggtgcgggcggcgaaggcttaggggccgcggcggccgccctgctcctccaccctccgccgccgccgcccccggccaccgcggccccgccgcccccgccgccgcccccgcctccccctgcctcagcggctgcccccgccagcgggccgcccgctcccccgggccttgcagcgggccccggcccggctggaggggccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtcatggcaaaaccccaaaagatgccgcgtcagttcgagccacgcatccaataccagcagcctgtgggatttattattttgaagtaaaaattgtcagtaagggaagagatggttacatgggaattggtctttctgctcaaggtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtattgctttcactgacctaccgccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaaaatggtttcatcttatttagtccaccatgggtactgtgccacagcagaggcctttgccagatctacagaccagaccgttctagaagaattagcttccattaagaatagacaaagaattcagaaattggtattagcaggaagaatgggagaagccattgaaacaacacaacagttatacccaagtttacttgaaagaaatcctaatctccttttcacattaaaagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccagtaatgatgtagacatggaaacagatcactactccaatggagttggagaaacttcatccaatggtttcctaaatggtagctctaaacatgaccacgaaatggaagattgtgacaccgaaatggaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggatgcattcagtctactagcatattcagatccctggaacagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccccactcccatataagcattcaatcagtgtaacttgcaaaatgcataaacatccgacagtttgaatttatagtgttgatggaagaaatcatttttaatgtgtactgtaaaacttgaaatactcaggagctgagtgaatatgtttgttgctacttacaatcccgacctgttagtcccagtagttttgttttaacatggtctttttcaactttgtttcctgtttaactacagatgacttctgttgtagactcacaagtttaactgttgtattataacagtattacatgtcaacggtgtggttatgacctttatttatataaaaaccaaatatttagtcaatttaccgtgtcttaatttaatctttgtacaccttccatttttaagtgcttaaatgagtactatattgcaataaaatgtagtgatataattaaccagccattaaaaatttacttctaca

SEQ ID NO: 358104 - DNA, 3504 bp, Homo sapiens
gcgctccggccaacgttctctcccggcctcccgggcccgccgcctactcccgcgtctccgagctcctcaaccgccgcggtctccctgggcgcgcggcccgccgcctgcttccggggcgggcggactgggcgcctggtgccggcggccgcagcgacagcgcccccgggaagcagaggaggaaggagagaagaggtggaggtggccgcaggctgagtcgcggccgggatgtccgggcagccgccgccgccgccgccgcagcagcagcaacagcagcagcagctgtcgccgccaccgccggcggccttggccccagtctccggagtcgtcctgccggcgcccccggccgtcagcgccggctcttctccggccggctcgcccggcggcggtgcgggcggcgaaggcttaggggccgcggcggccgccctgctcctccaccctccgccgccgccgcccccggccaccgcggccccgccgcccccgccgccgcccccgcctccccctgcctcagcggctgcccccgccagcgggccgcccgctcccccgggccttgcagcgggccccggcccggctggaggggccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtcatggcaaaaccccaaaagatgccgcgtcagttcgagccacgcatccaataccagcagcctgtgggatttattattttgaagtaaaaattgtcagtaagggaagagatggttacatgggaattggtctttctgctcaaggtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtattgctttcactgacctaccgccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaaaatggtttcatcttatttagtccaccatgggtactgtgccacagcagaggcctttgccagatctacagaccagaccgttctagaagaattagcttccattaagaatagacaaagaattcagaaattggtattagcaggaagaatgggagaagccattgaaacaacacaacagttatacccaagtttacttgaaagaaatcctaatctccttttcacattaaaagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccagtaatgatgtagacatggaaacagatcactactccaatggagttggagaaacttcatccaatggtttcctaaatggtagctctaaacatgaccacgaaatggaagattgtgacaccgaaatggaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggatgcattcagtctactagcatattcagatccctggaacagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccccactcccatataagcattcaatcagtgtaacttgcaaaatgcataaacatccgacagtttgaatttatagtgttgatggaagaaatcatttttaatgtgtactgtaaaacttgaaatactcaggagctgagtgaatatgtttgttgctacttacaatcccgacctgttagtcccagtagttttgttttaacatggtctttttcaactttgtttcctgtttaactacagatgacttctgttgtagactcacaagtttaactgttgtattataacagtattacatgtcaacggtgtggttatgacctttatttatataaaaaccaaatatttagtcaatttaccgtgtcttaatttaatctttgtacaccttccatttttaagtgcttaaatgagtactatattgcaataaaatgtagtgatataattaaccagccattaaaaatttacttctacagatacagtgtcaattgagtttatatattaggtacttgcatactttttatgattactatgaaaattagagcaattaaaattaatggtttctacaattaatctgagttctacaacctaaaattgccttcagtttactggcatccctggattagggttagacctgatattgtggctgacacagaaaggcaacaggaaattaacttcattattttcatattcataatatgg

SEQ ID NO: 358105 - DNA, 3200 bp, Homo sapiens
gcgctccggccaacgttctctcccggcctcccgggcccgccgcctactcccgcgtctccgagctcctcaaccgccgcggtctccctgggcgcgcggcccgccgcctgcttccggggcgggcggactgggcgcctggtgccggcggccgcagcgacagcgcccccgggaagcagaggaggaaggagagaagaggtggaggtggccgcaggctgagtcgcggccgggatgtccgggcagccgccgccgccgccgccgcagcagcagcaacagcagcagcagctgtcgccgccaccgccggcggccttggccccagtctccggagtcgtcctgccggcgcccccggccgtcagcgccggctcttctccggccggctcgcccggcggcggtgcgggcggcgaaggcttaggggccgcggcggccgccctgctcctccaccctccgccgccgccgcccccggccaccgcggccccgccgcccccgccgccgcccccgcctccccctgcctcagcggctgcccccgccagcgggccgcccgctcccccgggccttgcagcgggccccggcccggctggaggggccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtcatggcaaaaccccaaaagatgccgcgtcagttcgagccacgcatccaataccagcagcctgtgggatttattattttgaagtaagtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttagccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaaaatggtttcatcttatttagtccaccatgggtactgtgccacagcagaggcctttgccagatctacagaccagaccgttctagaagaattagcttccattaagaatagacaaagaattcagaaattggtattagcaggaagaatgggagaagccattgaaacaacacaacagttatacccaagtttacttgaaagaaatcctaatctccttttcacattaaaagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccagtaatgatgtagacatggaaacagatcactactccaatggagttggagaaacttcatccaatggtttcctaaatggtagctctaaacatgaccacgaaatggaagattgtgacaccgaaatggaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggatgcattcagtctactagcatattcagatccctggaacagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccccactcccatataagcattcaatcagtgtaacttgcaaaatgcataaacatccgacagtttgaatttatagtgttgatggaagaaatcatttttaatgtgtactgtaaaacttgaaatactcaggagctgagtgaatatgtttgttgctacttacaatcccgacctgttagtcccagtagttttgttttaacatggtctttttcaactttgtttcctgtttaactacagatgacttctgttgtagactcacaagtttaactgttgtattataacagtattacatgtcaacggtgtggttatgacctttatttatataaaaaccaaatatttagtcaatttaccgtgtcttaatttaatctttgtacaccttccatttttaagtgcttaaatgagtactatattgcaataaaatgtagtgatataattaaccagccattaaaaatttacttctaca

SEQ ID NO: 358106 - DNA, 2300 bp, Homo sapiens
attgattaaaaattagtcttgttattttttatttaggctttaatgtttttttcttttgccatttgtttcctccttttagttagaaattcagcttgtcagtatagtctgctttgaaaaacagcttctaatgccacttttttttttctttttaggtattgctttcactgacctaccgccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaaaatggtttcatcttatttagtccaccatgggtactgtgccacagcagaggcctttgccagatctacagaccagaccgttctagaagaattagcttccattaagaatagacaaagaattcagaaattggtattagcaggaagaatgggagaagccattgaaacaacacaacagttatacccaagtttacttgaaagaaatcctaatctccttttcacattaaaagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccagtaatgatgtagacatggaaacagatcactactccaatggagttggagaaacttcatccaatggtttcctaaatggtagctctaaacatgaccacgaaatggaagattgtgacaccgaaatggaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggatgcattcagtctactagcatattcagatccctggaacagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccccactcccatataagcattcaatcagtgtaacttgcaaaatgcataaacatccgacagtttgaatttatagtgttgatggaagaaatcatttttaatgtgtactgtaaaacttgaaatactcaggagctgagtgaatatgtttgttgctacttacaatcccgacctgttagtcccagtagttttgttttaacatggtctttttcaactttgtttcctgtttaactacagatgacttctgttgtagactcacaagtttaactgttgtattataacagtattacatgtcaacggtgtggttatgacctttatttatataaaaaccaaatatttagtcaatttaccgtgtcttaatttaatctttgtacaccttccatttttaagtgcttaaatgagtactatattgcaataaaatgtagtgatataattaaccagccattaaaaatttacttctaca

SEQ ID NO: 358107 - DNA, 2375 bp, Homo sapiens
gcgctccggccaacgttctctcccggcctcccgggcccgccgcctactcccgcgtctccgagctcctcaaccgccgcggtctccctgggcgcgcggcccgccgcctgcttccggggcgggcggactgggcgcctggtgccggcggccgcagcgacagcgcccccgggaagcagaggaggaaggagagaagaggtggaggtggccgcaggctgagtcgcggccgggatgtccgggcagccgccgccgccgccgccgcagcagcagcaacagcagcagcagctgtcgccgccaccgccggcggccttggccccagtctccggagtcgtcctgccggcgcccccggccgtcagcgccggctcttctccggccggctcgcccggcggcggtgcgggcggcgaaggcttaggggccgcggcggccgccctgctcctccaccctccgccgccgccgcccccggccaccgcggccccgccgcccccgccgccgcccccgcctccccctgcctcagcggctgcccccgccagcgggccgcccgctcccccgggccttgcagcgggccccggcccggctggaggggccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtcatggcaaaaccccaaaagatgccgcgtcagttcgagccacgcatccaataccagcagcctgtgggatttattattttgaagtaaaaattgtcagtaagggaagagatggttacatgggaattggtctttctgctcaaggtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtattgctttcactgacctaccgccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaaaatggtttcatcttatttagtccaccatgggtactgtgccacagcagaggcctttgccagatctacagaccagaccgttctagaagaattagcttccattaagaatagacaaagaattcagaaattggtattagcaggaagaatgggagaagccattgaaacaacacaacagttatacccaagtttacttgaaagaaatcctaatctccttttcacattaaaagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccagtaatgatgtagacatggaaacagatcactactccaatggagttggagaaacttcatccaatggtttcctaaatggtagctctaaacatgaccacgaaatggaagattgtgacaccgaaatggaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggtgaatatattttttcttgaaaaattatgaatatgtcagaggaactaaaatgtagttttgtgaaacactgagcagtgtaccagaaattcttgttagggaactgggacctgaccttccccctggctccttgcccatctgagagtggaaatatttgatgaagttaggcagttctgatctactggaaagagcattggactaaagca

SEQ ID NO: 358108 - DNA, 3064 bp, Homo sapiens
gcgctccggccaacgttctctcccggcctcccgggcccgccgcctactcccgcgtctccgagctcctcaaccgccgcggtctccctgggcgcgcggcccgccgcctgcttccggggcgggcggactgggcgcctggtgccggcggccgcagcgacagcgcccccgggaagcagaggaggaaggagagaagaggtggaggtggccgcaggctgagtcgcggccgggatgtccgggcagccgccgccgccgccgccgcagcagcagcaacagcagcagcagctgtcgccgccaccgccggcggccttggccccagtctccggagtcgtcctgccggcgcccccggccgtcagcgccggctcttctccggccggctcgcccggcggcggtgcgggcggcgaaggcttaggggccgcggcggccgccctgctcctccaccctccgccgccgccgcccccggccaccgcggccccgccgcccccgccgccgcccccgcctccccctgcctcagcggctgcccccgccagcgggccgcccgctcccccgggccttgcagcgggccccggcccggctggaggggccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtcatggcaaaaccccaaaagatgccgcgtcagttcgagccacgcatccaataccagcagcctgtgggatttattattttgaagtaaaaattgtcagtaagggaagagatggttacatgggaattggtctttctgctcaaggtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtattgctttcactgacctaccgccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaaaatggtttcatcttatttagtccaccatgggtactgtgccacagcagaggcctttgccagatctacagaccagaccgttctagaagaattagcttccattaagaatagacaaagaattcagaaattggtattagcaggaagaatgggagaagccattgaaacaacacaacagttatacccaagtttacttgaaagaaatcctaatctccttttcacattaaaagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccagtaatgatgtagacatggaaacagatcactactccaatggagttggagaaacttcatccaatggtttcctaaatggtagctctaaacatgaccacgaaatggaagattgtgacaccgaaatgggtctgcagtgatatttcttacatttttaataaaaaatgatggctacaaggttatgtttttacttgtactgattcacagctgatgagcataaaccagatttaaagatgtatgtgctgtaggacttgacagtaatgcatagcacttaaactcttgtttgagtgggctgctagagaaagtagagttacctttcagctacaggcagtgtttcttgctgaactgcttaggctcaggtttagcgctgtcactaatgcagcagtactgacttactggtgttgagcctctaggctattttaggttggagatgatagaacttcttatatttatgtcagtatagtcagtaaggccaaatggttagatgattttacaaattctaatcagtatttcttaaatgagtttaacgtaaacgtgtgtgactttgcatagtactatccctggtatatagtaggtgcttaagtatgacctccctcaccaaaaaaaaaaccccaccaccaacaaaaaaattatgtggctccaagacacattagcatgcataattttattttgtagacaacttaagtagtaaattgcctgtcccatcagcaaactatcccatcaaatggagagtgaaaatttatttgttggattacattttttcatttatttgttggaattccatggcaatgttagatttcttattattttgagattgagtggtattactaaaattgttttttaaaaagaaatgcagctttgttttactcttcaatatcagccacctcagtttctgaagagtaatttaagtacagtgataaagagcaggagttctagagccagattacatagatttgatttctgcaaaactgccatttactagctgtgtgaccttggaaaaattacttaactgctctgtgtctcagtttcttcatctgtaaaatgggtataataacgacctcataagttattgtgaaagtaaatgaataatccaaaaagctaatagcacaaagtgcttgggaaatattaaccatcatcatcgtcattaccttatttttaatgacttataagtaa

SEQ ID NO: 358109 - DNA, 1214 bp, Homo sapiens
gcgctccggccaacgttctctcccggcctcccgggcccgccgcctactcccgcgtctccgagctcctcaaccgccgcggtctccctgggcgcgcggcccgccgcctgcttccggggcgggcggactgggcgcctggtgccggcggccgcagcgacagcgcccccgggaagcagaggaggaaggagagaagaggtggaggtggccgcaggctgagtcgcggccgggatgtccgggcagccgccgccgccgccgccgcagcagcagcaacagcagcagcagctgtcgccgccaccgccggcggccttggccccagtctccggagtcgtcctgccggcgcccccggccgtcagcgccggctcttctccggccggctcgcccggcggcggtgcgggcggcgaaggcttaggggccgcggcggccgccctgctcctccaccctccgccgccgccgcccccggccaccgcggccccgccgcccccgccgccgcccccgcctccccctgcctcagcggctgcccccgccagcgggccgcccgctcccccgggccttgcagcgggccccggcccggctggaggggccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtcatggcaaaaccccaaaagatgccgcgtcagttcgagccacgcatccaataccagcagcctgtgggatttattattttgaagtaaaaattgtcagtaagggaagagatggttacatgggaattggtctttctgctcaaggtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttagttgcttcactgacctaccgcaattgtatcctactgtggctcaacaccaggagagtggcgatgccatttggcacaccaacgagttg

SEQ ID NO: 358110 - DNA, 417 bp, Homo sapiens
tagggagagtagtctcaacatagcatttgcagttatcttttcgaaaatagtacatgaatagaacaaaatgatgtttttcaaaagcttactttaaaggtgaggttcttaacgccttgtttcaaggaaataggttcgtttttataacaccagaatagattttgtttatataaattgtagtatgaagcatgtattctcttcactaaaagatgtatgtttcttctttttattttaagaatggtttcatcttatttagtccaccatgggtactgtgccacagcagaggcctttgccagatctacagaccagaccgttctagaagaattagcttccattaagaatagacaaagtaaggacactgtggtgcatggctaacatttgttttcagattatagatttggttactttaatttttagaaa

SEQ ID NO: 358111 - DNA, 488 bp, Homo sapiens
ttattagtctgtgcctggaagccatattttacctctcaacttggaaacatttgtgagcataatagttgaactatttgaattaaaaccaaatcgatgtgttttcaacaggatgcattcagtctactagcatattcagatccctggaacagcccagttggaaatcagcttgacccgattcagagagaacctgtgtgctcagctcttaacagtgcaatattaggtaagtaaagccaaataaggcacaatttcagttagattctctgaaaatttaagagagggtgtttgtactggcatttacactttggtaaaatcatcaggaaaatgttttctatatttttaaaatataaaaatacctaaaatatagaaaccccctcctttaattccagattcaagtggatttaaatagaataaaaacagtaagatggggtacaacttgggatgtttgggaaatagaagtttttgtgtgcatgtatgtaagcatttctggt

SEQ ID NO: 358112 - DNA, 3254 bp, Homo sapiens
gcgctccggccaacgttctctcccggcctcccgggcccgccgcctactcccgcgtctccgagctcctcaaccgccgcggtctccctgggcgcgcggcccgccgcctgcttccggggcgggcggactgggcgcctggtgccggcggccgcagcgacagcgcccccgggaagcagaggaggaaggagagaagaggtggaggtggccgcaggctgagtcgcggccgggatgtccgggcagccgccgccgccgccgccgcagcagcagcaacagcagcagcagctgtcgccgccaccgccggcggccttggccccagtctccggagtcgtcctgccggcgcccccggccgtcagcgccggctcttctccggccggctcgcccggcggcggtgcgggcggcgaaggcttaggggccgcggcggccgccctgctcctccaccctccgccgccgccgcccccggccaccgcggccccgccgcccccgccgccgcccccgcctccccctgcctcagcggctgcccccgccagcgggccgcccgctcccccgggccttgcagcgggccccggcccggctggaggggccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtcatggcaaaaccccaaaagatgccgcgtcagttcgagccacgcatccaataccagcagcctgtgggatttattattttgaagtaaaaattgtcagtaagggaagagatggttacatgggaattggtctttctgctcaaggtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttagccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaaaatggtttcatcttatttagtccaccatgggtactgtgccacagcagaggcctttgccagatctacagaccagaccgttctagaagaattagcttccattaagaatagacaaagaattcagaaattggtattagcaggaagaatgggagaagccattgaaacaacacaacagttatacccaagtttacttgaaagaaatcctaatctccttttcacattaaaagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccagtaatgatgtagacatggaaacagatcactactccaatggagttggagaaacttcatccaatggtttcctaaatggtagctctaaacatgaccacgaaatggaagattgtgacaccgaaatggaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggatgcattcagtctactagcatattcagatccctggaacagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccccactcccatataagcattcaatcagtgtaacttgcaaaatgcataaacatccgacagtttgaatttatagtgttgatggaagaaatcatttttaatgtgtactgtaaaacttgaaatactcaggagctgagtgaatatgtttgttgctacttacaatcccgacctgttagtcccagtagttttgttttaacatggtctttttcaactttgtttcctgtttaactacagatgacttctgttgtagactcacaagtttaactgttgtattataacagtattacatgtcaacggtgtggttatgacctttatttatataaaaaccaaatatttagtcaatttaccgtgtcttaatttaatctttgtacaccttccatttttaagtgcttaaatgagtactatattgcaataaaatgtagtgatataattaaccagccattaaaaatttacttctaca

SEQ ID NO: 358113 - DNA, 2786 bp, Homo sapiens
gcgctccggccaacgttctctcccggcctcccgggcccgccgcctactcccgcgtctccgagctcctcaaccgccgcggtctccctgggcgcgcggcccgccgcctgcttccggggcgggcggactgggcgcctggtgccggcggccgcagcgacagcgcccccgggaagcagaggaggaaggagagaagaggtggaggtggccgcaggctgagtcgcggccgggatgtccgggcagccgccgccgccgccgccgcagcagcagcaacagcagcagcagctgtcgccgccaccgccggcggccttggccccagtctccggagtcgtcctgccggcgcccccggccgtcagcgccggctcttctccggccggctcgcccggcggcggtgcgggcggcgaaggcttaggggccgcggcggccgccctgctcctccaccctccgccgccgccgcccccggccaccgcggccccgccgcccccgccgccgcccccgcctccccctgcctcagcggctgcccccgccagcgggccgcccgctcccccgggccttgcagcgggccccggcccggctggaggggccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtcatggcaaaaccccaaaagatgccgcgtcagttcgagccacgcatccaataccagcagcctgtgggatttattattttgaagtaaaaattgtcagtaagggaagagatggttacatgggaattggtctttctgctcaaggtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtattgctttcactgacctaccgttatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccagtaatgatgtagacatggaaacagatcactactccaatggagttggagaaacttcatccaatggtttcctaaatggtagctctaaacatgaccacgaaatggaagattgtgacaccgaaatggaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggatgcattcagtctactagcatattcagatccctggaacagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccccactcccatataagcattcaatcagtgtaacttgcaaaatgcataaacatccgacagtttgaatttatagtgttgatggaagaaatcatttttaatgtgtactgtaaaacttgaaatactcaggagctgagtgaatatgtttgttgctacttacaatcccgacctgttagtcccagtagttttgttttaacatggtctttttcaactttgtttcctgtttaactacagatgacttctgttgtagactcacaagtttaactgttgtattataacagtattacatgtcaacggtgtggttatgacctttatttatataaaaaccaaatatttagtcaatttaccgtgtcttaatttaatctttgtacaccttccatttttaagtgcttaaatgagtactatattgcaataaaatgtagtgatataattaaccagccattaaaaatttacttctaca

SEQ ID NO: 358114 - DNA, 1942 bp, Homo sapiens
agttatcagttacccttgaaagaatgtatatttttaagtagtgaggacaaatgccagaatgctatttaaaaacagcctaggagtggattgagtatgaggtccggaacgaggtgaagcgggttccaggagtgagatgtatttgttttgagagtgaggttttccccttacatactagaaatcagtgctgggggtagggggagagggctggctggggagttggtggggcagcagttgattaacgaagacgtacagatctgaatttgaaaaataataggattgtgtggaagtatgatttctccatattgatgtaaagtcataaaaccactacattttagcatatgtactttttttcctcccttacctccgggggtacaaatttgttaaaagtcagcgacatgtttggctttgaatacgttcaagatttaactaaataccttttttgcagatttctgttgccttatgaaattagtttattcgtaggctatgtagttcagtagtgatttattttaaactaagctgcaagtatgatatttctaaaattaggtttgttttttcgttttcagtaatgatgtagacatggaaacagatcactactccaatggagttggagaaacttcatccaatggtttcctaaatggtagctctaaacatgaccacgaaatggaagattgtgacaccgaaatggaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggatgcattcagtctactagcatattcagatccctggaacagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccccactcccatataagcattcaatcagtgtaacttgcaaaatgcataaacatccgacagtttgaatttatagtgttgatggaagaaatcatttttaatgtgtactgtaaaacttgaaatactcaggagctgagtgaatatgtttgttgctacttacaatcccgacctgttagtcccagtagttttgttttaacatggtctttttcaactttgtttcctgtttaactacagatgacttctgttgtagactcacaagtttaactgttgtattataacagtattacatgtcaacggtgtggttatgacctttatttatataaaaaccaaatatttagtcaatttaccgtgtcttaatttaatctttgtacaccttccatttttaagtgcttaaatgagtactatattgcaataaaatgtagtgatataattaaccagccattaaaaatttacttctaca

SEQ ID NO: 358115 - DNA, 2259 bp, Homo sapiens
gcgctccggccaacgttctctcccggcctcccgggcccgccgcctactcccgcgtctccgagctcctcaaccgccgcggtctccctgggcgcgcggcccgccgcctgcttccggggcgggcggactgggcgcctggtgccggcggccgcagcgacagcgcccccgggaagcagaggaggaaggagagaagaggtggaggtggccgcaggctgagtcgcggccgggatgtccgggcagccgccgccgccgccgccgcagcagcagcaacagcagcagcagctgtcgccgccaccgccggcggccttggccccagtctccggagtcgtcctgccggcgcccccggccgtcagcgccggctcttctccggccggctcgcccggcggcggtgcgggcggcgaaggcttaggggccgcggcggccgccctgctcctccaccctccgccgccgccgcccccggccaccgcggccccgccgcccccgccgccgcccccgcctccccctgcctcagcggctgcccccgccagcgggccgcccgctcccccgggccttgcagcgggccccggcccggctggaggggccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtcatggcaaaaccccaaaagatgccgcgtcagttcgagccacgcatccaataccagcagcctgtgggatttattattttgaagtaaaaattgtcagtaagggaagagatggttacatgggaattggtctttctgctcaaggtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtattgctttcactgacctaccgccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaaaatggtttcatcttatttagtccaccatgggtactgtgccacagcagaggcctttgccagatctacagaccagaccgttctagaagaattagcttccattaagaatagacaaagaattcagaaattggtattagcaggaagaatgggagaagccattgaaacaacacaacagttatacccaagtttacttgaaagaaatcctaatctccttttcacattaaaagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccaggtaagtaatttcactgacttttgcactaatataagcaacctagttataggtgtaatcgttgtaataattttgaaagaacttgaattatgtgacccacagaggggctctgggagttcttaagcccccagagaataaaagcgtagggagtcagttccccaaagctttttagtctcctattatgcacatgagctctttccttagtttcttcctcttctctactaccttcttccctctagtaaagttataaggacaaattcagggcttcatgcattgtcttcctgccagccacagagctatacaaatgatcacataaatgccatttgttatgttttcacagtggttaagacacagtagcatattt

SEQ ID NO: 358116 - DNA, 358 bp, Homo sapiens
tttaatgaaatatgctatcttaccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaagtaagagtgaagaaatttcaattgatgctattcagaatctgttttttataagacatttattctgttggtatccacagaagctttttaatccactaatttatatactgacatatctattatattattgattttaatctctcaacgaaaagta

SEQ ID NO: 358117 - DNA, 805 bp, Homo sapiens
aggagaaagtaaacaacaccccaagtgtccgggaacaaaggcaagttgtctttctacggtgccgcagccgtgtgcctcttctgaagaataagagctattattattctttatgtcttatccttttttttttttaaaaaaaaaccaagtttccttctaagggaaataaacaccaaaggtaggattccaaggaaatgactcacagcggctggcagggctctggcggggctggcccgggcccccgcgctccagcccgcagcagatgtcggcccggccttccctccctcccttgccggccaaacccgctggaagcccgcggttgcgggagcgccctgcgcccgtgggacctggcggcgaggacgcctattccctgcttctgcgaccacagctgggcactcggaaagttgctagggccgaagaggcgggaggggaggaagggaagcgagaggcggaggcgtggaccaggcgggcagcagcctcagcccgccgaggagtgatcctccgactgtgaaaaaccagacctctggctgcctggctccctaggaatcaagaagacgcacagactgaaaatcaagggaggaaggaacaagatcaaggatgaggattagcatctgcaaattgaactctatctaatttgcatgtttatttcttagaattgtaattaaatttgtgtaataaatgttttccatttcatttgtacacttaaaacttgggtgactgacatgcagttaagtgaatttcctttttttaaaagcaaatgtagattattcaataaagcagcaaaccaatattaaacataattagaact

SEQ ID NO: 358118 - DNA, 607 bp, Homo sapiens
gcggccgcagcgcttgagctgctgctggtccgctctgggctcggcgccagcccggccgccggtgcacactcgcgggtcccggcccggccgcccgctcggcggtgactgcgggtgcgcggcgggcaagggtcccggcaggtcccgccgccgcgactggggcgctgcgccgccgtcgctgcagacggttatggtaatgagcggctctgtctagcgaggagcgtgtgaaacccgtcaatcctgtttgccatttccccgtggatttccgaggagaggttctgcaggatgcccccaggtgatcctccgactgtgaaaaaccagacctctggctgcctggctccctaggaatcaagaagacgcacagactgaaaatcaagggaggaaggaacaagatcaaggatgaggattagcatctgcaaattgaactctatctaatttgcatgtttatttcttagaattgtaattaaatttgtgtaataaatgttttccatttcatttgtacacttaaaacttgggtgactgacatgcagttaagtgaatttcctttttttaaaagcaaatgtagattattcaataaagcagcaaaccaatattaaacataattagaact

SEQ ID NO: 358119 - DNA, 533 bp, Homo sapiens
tcagagtttattttttaaaatcattaattcataacttctgtctagggacccctccatagtcgagatgggtcatttcaggtgtaatgaaggcagaggcttggaaggcatagacctaataaaatcgggagaaggcacctgcacaaaagtgttacaaagactataatgtttgtttactgccactataccagatgtgctaaatataacacttctttaaaacagtgatcctccgactgtgaaaaaccagacctctggctgcctggctccctaggaatcaagaagacgcacagactgaaaatcaagggaggaaggaacaagatcaaggatgaggattagcatctgcaaattgaactctatctaatttgcatgtttatttcttagaattgtaattaaatttgtgtaataaatgttttccatttcatttgtacacttaaaacttgggtgactgacatgcagttaagtgaatttcctttttttaaaagcaaatgtagattattcaataaagcagcaaaccaatattaaacataattagaact

SEQ ID NO: 358120 - DNA, 489 bp, Homo sapiens
aggagaaagtaaacaacaccccaagtgtccgggaacaaaggcaagttgtctttctacggtgccgcagccgtgtgcctcttctgaagaataagagctattattattctttatgtcttatccttttttttttttaaaaaaaaaccaagtttccttctaagggaaataaacaccaaagtgatcctccgactgtgaaaaaccagacctctggctgcctggctccctaggaatcaagaagacgcacagactgaaaatcaagggaggaaggaacaagatcaaggatgaggattagcatctgcaaattgaactctatctaatttgcatgtttatttcttagaattgtaattaaatttgtgtaataaatgttttccatttcatttgtacacttaaaacttgggtgactgacatgcagttaagtgaatttcctttttttaaaagcaaatgtagattattcaataaagcagcaaaccaatattaaacataattagaact

SEQ ID NO: 358121 - DNA, 732 bp, Homo sapiens
gtcagagcagcagcatgggctgctggttgcccatttttgtgcctttttcttgattatttgctaaaaaggggtagattatttcatgcttcccctttttagaccataagggtaacttcctgacattgccacagcatttgtaaactgtcatactgctgatgggagcaagactggtcttctcccaccagagcctcccactgaccaaatctaactggaaaccaacaggcatgggagctgagaaatgtaatttaccggagtagctcctgtgagacagagtagggagaggaagagtgaagaatggatctgagagcaaataagcagatgaggagcacgaatcctcccaccagcattgtattcctggtacaacagaggctctccaagatcgtgcatcatcttgtaaccaaagaagatctacccacaagttcagaacagtttagcatagagtcaagtattaggaggccttgcttcttacctctatggtttcacgtcattgtatcgcctccctttggatctctcccttattttgggtggaggagcttctttggctggagcctatgctgatgggaccaacgttagagctttgatgcagagaaaaatttaaattctgcaggtacatactgttcttcctccccttctttgccatcttgtagacctgggccttttattgcagaggggaccaggcgagagagaagctaggggttcagtgcatcccgtctttctcctgggaaaacagga

SEQ ID NO: 358122 - DNA, 446 bp, Homo sapiens
aaaaaaaaaaaaaaaaaaaaaatgaaagttgcaagccaataaatggctttactaatctgcctcctcattttttagtggggtcaaaggtgttaatgaagaagccccggtgcatagccctcttgtctgccactatcccttttccttccttgtcctatatacttgtctctaataacgttaacataatctgatcctattaatatttacttcatgttttcctgcaggaagttggaaatctgtatgacatgttccacactcgcaactctttacaccgtagagcttatcaacacaaagttggcaacattattgatacaatgtaagaaacttgattgtcatttccctataaaattttccttgatacttggctagagtatcatactaggctcaactagacatttctagatgagttcaagtgaatattaagtgattaaattgaaaatggtttcctt

SEQ ID NO: 358123 - DNA, 939 bp, Homo sapiens
aagagccgctaggctgccctgcccgaagggctcaactgtcagtgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaagggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacggtatgtattcatacagtcaatagtcaataaaaagaaagactatttaagcaggttatttagttaatttatctgtttggttccactactgtgttataaaatacttccccattacagtgtccagggtgctttcattcacatatatatatatatgcttttgtttggttctcacagtagtctgtaaggaagttatcgttatctccctttttacaaataaaggaacttgaaactctt

SEQ ID NO: 358124 - DNA, 3832 bp, Homo sapiens
aagagccgctaggctgccctgcccgaagggctcaactgtcagtgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggtaattaatgatcctatccatggccacattgagctccaccctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacacctcaaaaaaaggaatggaacgacagtacttcagtccaaaatccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgctttaattttgtattttgaatgtacacgcatgctgaagctaagtaacttttaatcaaagaaataagatggtattaggcaaatcttactatactatgaaaagcattaccttgcctatttttaatattattaaagcctttctccttcagtagtctattttcttagaataacaactcttttatctattctgaactctattttttttcttttttaagagacaaggttttgctctgttgcccagcttggactcgaactttcctgggctcaagcgaccctcctgcctcagccccccaagtagctgggactaaagtcatgtgccaccacacccagcttactctgaacttttatgacagatgattgttttttgtttttaatgtagaaatgagacaagggtacaaattggaactagaaattgacattgtcattgacaaacatggctaaaaacaaaacatcaaatcctgcccccgtgaagagttccctgtcacctcaagtttgaggatagtcctctaagagtgacctaagcataagtgaaagacacctcccctcacccttctagccccctacaaggtgccaggttggggtaaagagttggagatgatggccaggagtggctccaacacgctggtgagaggcctgattaggttttggggaagatctgagagctctggcctcttcgtgagtggaacataaagccgcctcttgttgggagatcctaccccagtgacagaggaatcccccaaactaggctgtgccctggctccgtggcggctccagacccgggtagtgcctttgtcccctgaatactcactcccccggtccagagggccttcccactgcccagcctggagaaggcctcccctgacctgctctctcagtatcctggagagctggccagaggccatcacaggcatcatcctcagagctcctcagacctgggactttgtttttgctggttcagtgcattttgtgtatttaagagcaaacactagccaggcgtggcggcgtgtgcctgtagtcccagctacttgggaggctgaggcaggaggattgctcgaacctgggaggcggaggttgcagtgagcctagatcacgccattgcactccagcctgggtgacagagtgagactccatctccaaaaaaaaaagcacaaacactgcactgcctgtgctgaaattagtgaccacccagtgggctccaggctccgctaggtaacttcgttttcccagcagtggagtgggcaccaccttggtggggcagtgcccctgtgcccagggcacacctcattcccagttctatagcaattcaccaagaacaaagtctgcagttagagccaaagctggtggtggccagagggtgctgaagatacaggccagtggggatgggagccatgagccccgaatgtcttctgctctgatgctccccggactaagcctccctggcacactgggagtgaggggcagcctgagcaagtaggggaactcagaccacaggccagcagatttcccagcagtccatcactggccaccgtgtagccagattctgttccgtccacactggggtgaagagtacttggaatgtctgccatcctgtatgatcaccccaccccctgtccatccatcagtagataataagggttggttacaattcataagagaatagttaaaacacttctcctctcatgcctac

SEQ ID NO: 358125 - DNA, 1803 bp, Homo sapiens
  misc_feature (33)..(33): n is a, c, g, or t
gagggtatgaaatgatccatagtgtcaattagnctgtttgcatgcacccagcctctctctgcttcacgagtggatagatcatcgccggactccctatatcgactcgtacattcaataccgactgagacggtggttaaccagtctttaactgaagtcggtacacacaactcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacacctcaaaaaaaggaatggaacgacagtacttcagtccaaaatccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgctttaattttgtattttgaatgtacacgcatgctgaagctaagtaacttttaatcaaagaaataagatggtattaggcaaatcttactatactatgaaaagcattaccttgcctatttttaatattattaaagcctttctccttcagta

SEQ ID NO: 358126 - DNA, 1899 bp, Homo sapiens
taatcagctcggtaccgtcttgatgagtctcgttttgaaaatcttggagtattccttgggggagaggaagaagctgcttagttatatccagcgattggttcaaatccacgttgatacaatgaaggtaattaatgatcctatccatggccacattgagctccaccctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacacctcaaaaaaaggaatggaacgacagtacttcagtccaaaatccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgctttaattttgtattttgaatgtacacgcatgctgaagctaagtaacttttaatcaaagaaataagatggtattaggcaaatcttactatactatgaaaagcattaccttgcctatttttaatattattaaagcctttctccttcagta

SEQ ID NO: 358127 - DNA, 1282 bp, Homo sapiens
aaaaaaaaaaaaaaaaaaaaaatgaaagttgcaagccaataaatggctttactaatctgcctcctcattttttagtggggtcaaaggtgttaatgaagaagccccggtgcatagccctcttgtctgccactatcccttttccttccttgtcctatatacttgtctctaataacgttaacataatctgatcctattaatatttacttcatgttttcctgcaggaagttggaaatctgtatgacatgttccacactcgcaactctttacaccgtagagcttatcaacacaaagttggcaacattattgatacaatgattacagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacacctcaaaaaaaggaatggaacgacagtacttcagtccaaaatccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgctttaattttgtattttgaatgtacacgcatgctgaagctaagtaacttttaatcaaagaaataagatggtattaggcaaatcttactatactatgaaaagcattaccttgcctatttttaatattattaaagcctttctccttcagta

SEQ ID NO: 358128 - DNA, 1180 bp, Homo sapiens
tagacagtctcgctctgtcacccaggttggaatgcagtggcacacaatcttggctcactgcaacctccacctcccggattcaagcaattctccagcctaagcctcccgagtagttgggattacaggcacccgccaccacgcccagctaatttttgtatttttagtagagacggggtttcaccatgtcggtcaggctggtctcgaactcccgacctcatgatccgcccacctgggcctcccaaagtgctgggattatagacgtgagccactgcgcctggccactttttacaattttttacaaaaatgctctctttgtttaacgagtgacattggtaggagctatatttgttaaggatatctctaatcgtttttcttagttaggtgccattttcataaagagaacctgtttgtggctcaaagacttgatgaaaaatggattctaacatggggagtcttgtgttttccaggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacacctcaaaaaaaggaatggaacgacagtacttcagtccaaaatccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgctttaattttgtattttgaatgtacacgcatgctgaagctaagtaacttttaatcaaagaaataagatggtattaggcaaatcttactatactatgaaaagcattaccttgcctatttttaatattattaaagcctttctccttcagta

SEQ ID NO: 358129 - DNA, 1970 bp, Homo sapiens
  misc_feature (1925)..(1925): n is a, c, g, or t
  misc_feature (1939)..(1939): n is a, c, g, or t
aagagccgctaggctgccctgcccgaagggctcaactgtcagtgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggtaattaatgatcctatccatggccacattgagctccaccctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcagatggcnatgttatagccccnctatagtcactacgtccggggatcctgtagt

SEQ ID NO: 358130 - DNA, 1927 bp, Homo sapiens
aagagccgctaggctgccctgcccgaagggctcaactgtcagtgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggtaattaatgatcctatccatggccacattgagctccaccctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggtgagttatcaggcatctttccattagtgaaaggttatctctgtcctccaagaggagaccactaacctatcgtgatactatgactctgtactaagtgctttacgtttattctcatttaatcttcacagtagtgcaggggtcttaggcctgttttacagatagagaaactgaggcttcactgagattaaataacttgctcatgaaagcatatttagccaggattcaaaagccaggtctaacttaactccaaatctttgatctcatccaggaagtgagagtgggtctccaattttggctagattcagacatgagaaaatgaatataagggaaaggaacctcaaaag

SEQ ID NO: 358131 - DNA, 2391 bp, Homo sapiens
acagagacccttgaacacacaggattcaactgtaagtctactttatatgtggatttatttcaataaatatattgacatattttttggaggtttgccaacaattcgaaaacacttgcggacaaaccaaaattaagaaaaagagttgtccatgaatgcataagacatatgtagcctcatcttacgcatttactcacgataaaatatacataaatctattacatacaaagttgcagcatttatcaaaacttatgcacacaaactcttacagaccgtatatggtaccattcacattgagagaaatgtaaacaaacgtaaagatgcacacggtactctgtatggggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacacctcaaaaaaaggaatggaacgacagtacttcagtccaaaatccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgctttaattttgtattttgaatgtacacgcatgctgaagctaagtaacttttaatcaaagaaataagatggtattaggcaaatcttactatactatgaaaagcattaccttgcctatttttaatattattaaagcctttctccttcagtagtctattttcttagaataacaactcttttatctattctgaactctattttttttcttttttaagagacaaggttttgctctgttgcccagcttggactcgaactttcctgggctcaagcgaccctcctgcctcagccccccaagtagctgggactaaagtcatgtgccaccacacccagcttactctgaacttttatgacagatgattgttttttgtttttaatgtagaaatgagacaagggtacaaattggaactagaaattgacattgtcattgacaaacatggctaaaaacaaaacatcaaatcctgcccccgtgaagagttccctgtcacctcaagtttgaggatagtcctctaagagtgacctaagcataagtgaaagacacctcccctcacccttctagccccctacaaggtgccaggttggggtaaagagttggagatgatggccaggagtggctccaacacgctggtgagaggcctgattaggttttggggaagatctgagagctctggcctcttcgtgagtggaacataaagccgcctcttgttgggagatcctaccccagtgacagaggaatcccccaaactaggctgtgccctggctccgtggcggctccagacccgggtagtgcctttgtcccctgaatactcactcccccggtccagagggccttcccactgcccagcctggagaaggcctcccctgacctgctctctcagtatcctggagagctggccagaggccatcacaggcatcatcctcagagctcctcagacctgggactttgtttttgctggttcagtgcattttgtgtatttaagagcaaacactagccaggcgtggcggcgtgtgcctgtagtcccagctacttgggaggctgaggcaggaggattgctcgaacctgggaggcggaggttgcagtgagcctagatcacgccattgcactccagcctgggtgacagagtgagactccatctccaaaaaaaaaagcacaaacactgcactgcctgtgctgaaattagtgaccacccagtgggctccaggctccgctaggtaacttcgttttcccagcagtggagtgggcaccaccttggtggggcagtgcccctgtgcccagggcacacctcattcccagttctatagcaattcaccaagaacaaagtctgcagttagagccaaagctggtggtggccagagggtgctgaagatacaggccagtggggatgggagccatgagccccgaatgtcttctgctctgatgctccccggactaagcctccctggcacactgggagtgaggggcagcctgagcaagtaggggaactcagaccacaggccagcagatttcccagcagtccatcactggccaccgtgtagccagattctgttccgtccacactggggtgaagagtacttggaatgtctgccatcctgtatgatcaccccaccccctgtccatccatcagtagataataagggttggttacaattcataagagaatagttaaaacacttctcctctcatgcctac

SEQ ID NO: 358132 - DNA, 1039 bp, Homo sapiens
ctgggtagaaatagagatgagtttaaagacaaataaatactgttgattttgagataggcctttaagtacaagtatcatgacaataggatgacttttttttgagacagagtcttgctctgttgcccaggctggagtgcaagagcaaaattccatctcaaaaaaaaataataacacattttttaaaaactatttttaatagttctatcaagtcagatccagtgtagttcaacagaaaaaatttaacatgggggtgagatacaaaagttttggcagagctaaatgagcatagaggacagtgattcaacagcaggaagctgctaccacctctaggataggagagaccaagggagcaggtgggagtccaggagctggggccacctgcaaaagctagaaccacagaatagtcactgccactgccgctcgtgccagaggaggtagggagagaaaaaacctgacttctctgccctcttctcacctccagtctcccaccagagcctcccactgaccaaatctaactggaaaccaacaggcatgggagctgagaaatgtaatttaccggagtagctcctgtgagacagagtagggagaggaagagtgaagaatggatctgagagcaaataagcagatgaggagcacgaatcctcccaccagcattgtattcctggtacaacagaggctctccaagatcgtgcatcatcttgtaaccaaagaagatctacccacaagttcagaacagtttagcatagagtcaagtattaggaggccttgcttcttacctctatggtttcacgtcattgtatcgcctccctttggatctctcccttattttgggtggaggagcttctttggctggagcctatgctgatgggaccaacgttagagctttgatgcagagaaaaatttaaattctgcaggtacatactgttcttcctccccttctttgccatcttgtagacctgggccttttattgcagaggggaccaggcgagagagaagctaggggttcagtgcatcccgtctttctcctgggaaaacagga

SEQ ID NO: 358133 - DNA, 1036 bp, Homo sapiens
  misc_feature (908)..(908): n is a, c, g, or t
aagagccgctaggctgccctgcccgaagggctcaactgtcagtgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggtaattaatgatcctatccatggccacattgagctccaccctctcctcgtccgaatcattgatacacctcaatttcaacgtcttcgatacatcaaacagctgggaggtggttactatgtttttccaggagcttcacacaatcgatttgagcatagtctagggtaagaagggaatggggtggggaacttgcagtttttaagtattttctctgtctcatgaaatagttatcttaggccaggcatggtggctcacacctataatcccagcactttgggaggcagaggtgggtggatcacatgaggtcaggagttcaagaccagcctggccaacattgtgaaaccccatctttactacaaatacaaaattagccagacatgattgtgcgcncctgtaatcctagctactcaggaggctgaggcaggaggatcacttgaacccaggaggttggtggttgcagtgagctgagattgcaccatcgcactccagcctaggcaacaagagcaaaaccccatctc

SEQ ID NO: 358134 - DNA, 858 bp, Homo sapiens
aagagccgctaggctgccctgcccgaagggctcaactgtcagtgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggtaagaggatctgagtttgttatgttttttgaatataaagtgatataactcaattatgtaaaattcattttgaagagaataggaggaaatctgcttctcagtgatagaattgtgagtagtggatcttttctaaactttctgcactttctaaaatgagcacagagtatttaaatcagaagaagaactaaaatatgtttaagcatacagaaaagcataagtagaccactacccaacttgtcaaatattaatattttgcctaatttgcttcaagtctgttatttttagagcaaaatattagaaactattgaagacctcctttgtacattctttttttttt

SEQ ID NO: 358135 - DNA, 873 bp, Homo sapiens
ttgattgtgaatgagtgagcagagagagatgagcaaacaggccaattggagatttcaagggagatctttgtttttactggcaagtttgcagttaccccttttcaccactagatggtagtgcctaacagagcttataactgcacgtgttcaaaggctgatgaaaaaataaaattcaattttatgatgatatttattaaaatgtaattctgtctacatgatcttataatattcatttaggaactgtaaatgattatatcattaaatgcattaaatatgtttatgaaataagttttgtaaaaggtttgtagactactagtaaaatgaaaaatctgacaggtttttaaaaatgttcctaagattgtggttagaaactagagaattaatatgcaatagacctttatctcagaattacttggaattgaggataattttgttagtcagggctcccaatgggctagaatctttaacacatcatattgtgcttacttttcctagcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattggtaagtttatgtacagcttaattttaactgactggtgcttttcatctagccttttcatgattccttctgagttatacatttggctattttagaggctaaatgataaaatatgagttctatgtttctactgtttaatgcaaaaaataaaaggcttatatttttttctacctctcaactgaattagttagaagttacttcccaaaaatatatatacagaaattc

SEQ ID NO: 358136 - DNA, 2296 bp, Homo sapiens
aagagccgctaggctgccctgcccgaagggctcaactgtcagtgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggtaattaatgatcctatccatggccacattgagctccaccctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacacctcaaaaaaaggaatggaacgacagtacttcagtccaaaatccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgctttaattttgtattttgaatgtacacgcatgctgaagctaagtaacttttaatcaaagaaataagatggtattaggcaaatcttactatactatgaaaagcattaccttgcctatttttaatattattaaagcctttctccttcagta

SEQ ID NO: 358137 - DNA, 2800 bp, Homo sapiens
aagagccgctaggctgccctgcccgaagggctcaactgtcagtgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggtaattaatgatcctatccatggccacattgagctccaccctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacacctcaaaaaaaggaatggaacgacagtacttcagtccaaaatccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgctttaattttgtattttgaatgtacacgcatgctgaagctaagtaacttttaatcaaagaaataagatggtattaggcaaatcttactatactatgaaaagcattaccttgcctatttttaatattattaaagcctttctccttcagtagtctattttcttagaataacaactcttttatctattctgaactctattttttttcttttttaagagacaaggttttgctctgttgcccagcttggactcgaactttcctgggctcaagcgaccctcctgcctcagccccccaagtagctgggactaaagtcatgtgccaccacacccagcttactctgaacttttatgacagatgattgttttttgtttttaatgtagaaatgagacaagggtacaaattggaactagaaattgacattgtcattgacaaacatggctaaaaacaaaacatcaaatcctgcccccgccatgagatgttggaaggaggcatccttccaacatctcatggcgagctcaggtgattgatactcctgatgcgagtaatacggatgtgtttaggagtgggacttctaggggatttagcggggtgatgcctgttgggggccagtgccctcctaattggggggtaggggctaggcatgagatgttggaagg

SEQ ID NO: 358138 - DNA, 2343 bp, Homo sapiens
aagagccgctaggctgccctgcccgaagggctcaactgtcagtgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggtaattaatgatcctatccatggccacattgagctccaccctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgatttggtgcctatcctaaaacttccagtgggttttcttgccttccagtggccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacacctcaaaaaaaggaatggaacgacagtacttcagtccaaaatccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgctttaattttgtattttgaatgtacacgcatgctgaagctaagtaacttttaatcaaagaaataagatggtattaggcaaatcttactatactatgaaaagcattaccttgcctatttttaatattattaaagcctttctccttcagta

SEQ ID NO: 358139 - DNA, 1738 bp, Homo sapiens
taatcagctcggtaccgtcttgatgagtctcgttttgaaaatcttggagtattccttgggggagaggaagaagctgcttagttatatccagcgattggttcaaatccacgttgatacaatgaagggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacacctcaaaaaaaggaatggaacgacagtacttcagtccaaaatccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgctttaattttgtattttgaatgtacacgcatgctgaagctaagtaacttttaatcaaagaaataagatggtattaggcaaatcttactatactatgaaaagcattaccttgcctatttttaatattattaaagcctttctccttcagta

SEQ ID NO: 358140 - DNA, 2477 bp, Homo sapiens
aagagccgctaggctgccctgcccgaagggctcaactgtcagtgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggtaattaatgatcctatccatggccacattgagctccaccctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcagtctcccaccagagcctcccactgaccaaatctaactggaaaccaacaggcatgggagctgagaaatgtaatttaccggagtagctcctgtgagacagagtagggagaggaagagtgaagaatggatctgagagcaaataagcagatgaggagcacgaatcctcccaccagcattgtattcctggtacaacagaggctctccaagatcgtgcatcatcttgtaaccaaagaagatctacccacaagttcagaacagtttagcatagagtcaagtattaggaggccttgcttcttacctctatggtttcacgtcattgtatcgcctccctttggatctctcccttattttgggtggaggagcttctttggctggagcctatgctgatgggaccaacgttagagctttgatgcagagaaaaatttaaattctgcaggtacatactgttcttcctccccttctttgccatcttgtagacctgggccttttattgcagaggggaccaggcgagagagaagctaggggttcagtgcatcccgtctttctcctgggaaaacagga

SEQ ID NO: 358141 - DNA, 2047 bp, Homo sapiens
aagagccgctaggctgccctgcccgaagggctcaactgtcagtgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggtaattaatgatcctatccatggccacattgagctccaccctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggtaggtggctgttactcacaaactttgcacaattttttatttttaagtaaaaaccaaaagtaagtctatctgctgaaaagttcccatttaagttatagtcatttggttatggttttgaaaataaggtc

SEQ ID NO: 358142 - DNA, 1405 bp, Homo sapiens
aagagccgctaggctgccctgcccgaagggctcaactgtcagtgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggtaattaatgatcctatccatggccacattgagctccaccctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgtaagaaacttgattgtcatttccctataaaattttccttgatacttggctagagtatcatactaggctcaactagacatttctagatgagttcaagtgaatattaagtgattaaattgaaaatggtttcctt

SEQ ID NO: 358143 - DNA, 905 bp, Homo sapiens
cagcactttgggaatccaaggcaggcggattgcttgaggccaggagttcgagaccagcctggccaatgtggcaaaaccctgtctctagactttgtcccagaaaaaaaaaaaaaggagctgtgttttcagacagagcttagtgcagccagttcttgatggctgtgcaatgctttccttttaagagtggagttagcctcgtcataaagcgtgtttttgagtctgttcgaacgggtcaacaacgaagggaagtttcaggcagatcttgtatgcctggccctggtggctgctttcatttccttccagtatcagtgctaaacaggaatgaacatgttcaagccccgtctcacccacctctggcatcttcgccctaactctgccctagaagacctttccttccgtatcgtcaagaaaactgaagttgctgtttcactccttctcccacccagaaactttgctgcatcttcctggatccctagctccttgcacccatgatcctgtctccttcctcagcccggcttctggctgagcagcctgcacttgctgtcttcactcctacacgctgcccccactcctacacgctgcccctgcgtgcttctcacttctctacccttccagccctgcactctggggacctgtgcgtatgtttgtgtgattatcaatctgttgaacccaggaggtcgaggctgcagtgaggcataatcacgccactgcactccagcctgggtaatagagcaagatcctgtctttaaaataataattatgattgggtatggtggcacacatctgtagtcccagctactcgggaggctgaggcacaagaattgcttgagacccagaggcggaggttggagtgagctaggatggtgccactgcattccagcctgggcggcagagtgagactgtct

SEQ ID NO: 358144 - DNA, 385 bp, Homo sapiens
tcaaaaggaaattctcattaaaacaactatgagaatgagagaaatcatgatactaagatagtatgtaatctttagagtttaaaatagttgttcctagcccctaaagtgatattattttgacttccttaagcatagagaactttgtttacagtagttctactctgcagttaggtgtaataaaccagcattctttacaaaactcaaatgagaccttggaacctgagctatatgagtaacacatatatgatcctgtgatctatatgatatattatttgtcatttctctattcccagcttgaaatttaatataaaaaaaagtttcactgcttcattctaaatcctgtttgatccaacatggaaaacattgttttagatttcttaatgta

SEQ ID NO: 358145 - DNA, 6187 bp, Homo sapiens
tggggacgttgacaagtggatccaagatggcgtagaaagtaatgacaggatttggatgaagtaatggatcactaatgaactacagtgctggtgagatgtgtaagaaattataaagagctctgatgggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcacaatcgagagtcttctctacagaattgcctcatttttgcaactgaaaaattatgtgcaagctgatgaagattgtagacatgtgctgggagaaggactggccaagggagaagatgcctttcgggcagtgctttgctgcatgcagctgaaagggaagctccaacctgtatccaccattcttgccaagtcactcacaggagagtccctgaatgggatggtaacaaaggatttgacaagactaaaaacacttctctcagaaacagagatttttagaacaaggaatctgtaggtatggtgcccagtgtacttcagcacattcccaggaagaactagcagaatggcagaaaagatatgcttcacggctgataaaattgaaacagcaaaatgagaataaacagctctcaggcagttacatggaaaccttgatagaaaagtggatgaattcattgtctcctgagaaagtgcttagtgaatgtatagaaggagtaaaggtagagcacaatcctgacctgtcagttactgtcagcaccaaaaaatcccaccagacatggacctttgctctcacttgtaagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaagatctcgaatacctgatgcatgcaaaacagcagctagtaaccacagctaaacgttgggattcttcctctaagactattatagattttgaacctaatgaaactactgatttggagaagagccttcttatcagataccaaattcccctctctgctgaccagctatttactcagtccgttttagacaaatcattgaccaagagcaactatcagtcacggttacatgaccttctttatattgaggagatagcccagtataaagaaatcagcaagttcaaccttaaagtgcaattgcagattctggcaagcttcatgctcactggtgtttctggaggtgcaaagtatgctcagaatggacaactttttggtcgctttaagcttactgaaacactttctgaagatactttggctggacgactggtgatgaccaaagtcaatgctgtttatttattaccagtccctaaacagaagttagtacagacccagggaaccaaagagaaggtttatgaagctactattgaagaaaaaacaaaggaatatatatttttaaggctatctagggaatgctgtgaagaacttaatcttcggcctgactgtgacacacaggttgaacttcagtttcaattaaatcgattacccctctgtgaaatgcactatgcactagacaggatcaaggacaatggggttttgtttccagacatcagtatgactcccaccataccatggagtcctaacagacaatgggatgaacagttggatcctcgactaaatgcaaaacagaaagaggctgttctggccattaccactccacttgcaatccagctgccgcctgtgcttatcatcggaccctatgggacaggcaaaacgttcactctagctcaggctgtcaaacatattctgcagcaacaggagactaggattctcatttgcacccattctaatagtgctgctgatctctacataaaggattatttacatccatatgtagaagcaggcaatccccaggcaagacctctcagggtatatttcagaaatcgctgggtaaagactgtccacccagttgtgcatcagtactgtttgatctcaagcgcacattccacctttcagatgccccagaaagaagatattcttaaacatcgagtggtggttgttaccttgaatacttcccagtacctctgtcagttggaccttgaacctgggttttttacacacattctattagatgaagctgcccaggccatggagtgtgaaaccattatgcctctagcattagcaactcaaaacactcggattgtcttggctggtgatcacatgcagctcagtccttttgtttacagcgagtttgccagggagagaaaccttcacgtttcattacttgaccgactctatgagcattaccctgctgagttcccatgtaggattctcctgtgtgagaactaccgctcccatgaagctatcatcaattatacctctgagcttttctatgagggcaaactgatggccagtgggaagcagccagcacacaaagatttctacccactaactttctttacagcacgaggagaagatgtacaagaaaaaaatagcacagctttttataataatgcagaggtgtttgaagtggtggaacgtgtagaagagttaagaaggaagtggccagtagcgtgggggaagttagatgatggcagtattggtgtggtgactccatatgctgatcaagtgtttagaatacgtgctgaacttcgaaaaaagagattatctgatgttaatgtagaaagggtgctaaatgttcaaggaaagcaattcagagttttgtttcttagcacagtacgtacaagacatacttgtaaacataaacagacaccaattaaaaagaaagagcaacttctggaagattccacagaggacttagattatggttttttatctaactacaagcttctcaatactgccatcacaagagcacaatccctggttgctgtggtgggtgatcccattgctctgtgctctattggaagatgcaggaaattttgggaacggtttattgccctgtgtcatgaaaacagtagcctacatggaatcacttttgaacagatcaaagcccagttagaggctttagaactaaagaagacatatgtgttgaatccgctggcacctgaatttatcccccgggctctaagactgcagcattcaggaagtaccaacaaacagcagcaatcaccacccaaggggaaaagtcttcatcatacccagaatgatcacttccagaatgatggaattgttcagcccaatccttctgtacttattggcaatcctattagagcatatactcctccaccccctcttggacctcacccaaatttgggaaaatctccaagccctgttcaaagaatagatcctcacactgggacaagtattctttatgtacctgctgtctatggagggaatgtagttatgtcggtgcctttacctgtaccatggacaggataccagggtaggtttgcagttgatcctcgaattattacacatcaggcagcaatggcctataacatgaacctattacagacacatggacgaggatctcctattccttatggccttggacatcacccacctgtcaccataggccagccacaaaatcagcatcaggagaaggatcaacatgagcaaaatcgaaatggtaaaagtgatacaaataattccggacctgaaattaataagattcgaacaccagagaaaaagccaacagaaccaaaacaggttgatttggaatcaaatccacagaacagaagtcctgaatcacgtcctagtgttgtttatcccagtaccaaatttcctcgcaaagataatctcaacccaagacacataaatcttccccttcctgctccccacgcacagtatgcaatccctaatcgccactttcatccccttccccagctaccaagaccaccctttccaattccacagcagcacaccttgttaaatcagcagcagaataatttgcctgaacaaccaaatcagataccacctcagccaaatcaggtagtccagcagcaaagtcagttgaatcagcagcctcagcagccacctcctcagctttctcctgcatatcaggcgggacccaacaatgctttttttaatagtgcagttgctcatcggccacagtctcctcctgcagaagctgtaattccggagcagcagccccctcccatgctgcaagaaggccacagtcctctgagagccattgcacaacccggccccattcttccttcacatctgaatagcttcattgatgagaacccctcgggattacctataggggaggctttagatcgtatacatgggagtgtcgctctggaaacattaaggcagcagcaggcacggttccagcagtggagcgagcatcatgcctttctcagtcagggcagcgttccatacccacaccatcaccatcctcacctccagcatcttcctcagccgcccctgggattacatcagccgccagtgcgggcagactggaagctcaccagcagtgccgaagatgaagtggagaccacatactcaaggtttcaagacttaatcagagaactgtctcatcgtgatcaaagtgaaacacgggaactagctgaaatgccaccacctcaatcaagacttttgcaatatagacaagtacagagtagaagcccaccagcagtcccatctcccccatccagtacagaccacagtagccacttttctaactttaatgataacagcagagacattgaagtagccagcaacccagcatttccacagcgcctcccaccccagatattcaactcacctttctcgttgccatctgaacaccttgcccctcctcccttgaaatacctggcacctgatggagcatggacttttgctaacttgcaacagaatcacctaatggggccaggttttccctatggcctacctccattgcctcacaggccaccgcagaacccttttgtacaaatacagaatcatcaacatgctattggtcaagagccatttcacccattgtcatctcgaacagtatcttcttcttcgctccctagcttagaagagtatgagcccagaggacctggtcggcccttgtaccaaagaagaatctcatctagctcagttcaaccttgttctgaagaagtaagcactcctcaagacagtctggctcagtgtaaagagcttcaggaccacagtaaccaatcttctttcaacttttcatccccggagtcctgggtaaacaccacctcatctactccttatcagaacattccgtgcaatggatccagcaggacagctcagcccagagagttgatagcgccacccaagactgtcaaaccccctgaggatcaactgaagtcggagaacctcgaggtgtccagttccttcaactacagtgtgctgcagcatcttggccagtttccaccccttatgcctaacaagcagatcgcggagtcggccaatagcagtagcccccagagctctgcggggggcaagcccgccatgtcctatgccagcgctctgcgggcccctccaaagcccaggccccctcctgagcaggccaagaagagtagcgaccctctgtctctcttccaggaactgagctttccctcaagggagaatgttttaatttctgtttgtatcagtagaattaaggtagttggacttcatctatagatgcacagttccctttgttttaatattaaatatgttctcacttaattgctttgctgctagacttgcaactaatttttttaaagtatattccattattttgcatttttgatgtgtcaaaactttgacagcttttatgtagaataaaaaaatttttaaatttgtgtattgttacatatgtttgcatcaagctagcagccaagaggttaattgtgctcctattctgtaaaagactgcaagtattgtttgtgtacaatgtatgtaaaaaaagaacaaaaaacgcgag

SEQ ID NO: 358146 - DNA, 5428 bp, Homo sapiens
tggggacgttgacaagtggatccaagatggcgtagaaagtaatgacaggatttggatgaagtaatggatcactaatgaactacagtgctggtgagatgtgtaagaaattataaagagctctgatgggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcacaatcgagagtcttctctacagaattgcctcatttttgcaactgaaaaattatgtgcaagctgatgaagattgtagacatgtgctgggagaaggactggccaagggagaagatgcctttcgggcagtgctttgctgcatgcagctgaaagggaagctccaacctgtatccaccattcttgccaagtcactcacaggagagtccctgaatgggatggtaacaaaggatttgacaagactaaaaacacttctctcagaaacagagatttttagaacaaggaatctgtaggtatggtgcccagtgtacttcagcacattcccaggaagaactagcagaatggcagaaaagatatgcttcacggctgataaaattgaaacagcaaaatgagaataaacagctctcaggcagttacatggaaaccttgatagaaaagtggatgaattcattgtctcctgagaaagtgcttagtgaatgtatagaaggagtaaaggtagagcacaatcctgacctgtcagttactgtcagcaccaaaaaatcccaccagacatggacctttgctctcacttgtaagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaagatctcgaatacctgatgcatgcaaaacagcagctagtaaccacagctaaacgttgggattcttcctctaagactattatagattttgaacctaatgaaactactgatttggagaagagccttcttatcagataccaaattcccctctctgctgaccagctatttactcagtccgttttagacaaatcattgaccaagagcaactatcagtcacggttacatgaccttctttatattgaggagatagcccagtataaagaaatcagcaagttcaaccttaaagtgcaattgcagattctggcaagcttcatgctcactggtgtttctggaggtgcaaagtatgctcagaatggacaactttttggtcgctttaagcttactgaaacactttctgaagatactttggctggacgactggtgatgaccaaagtcaatgctgtttatttattaccagtccctaaacagaagttagtacagacccagggaaccaaagagaaggtttatgaagctactattgaagaaaaaacaaaggaatatatatttttaaggctatctagggaatgctgtgaagaacttaatcttcggcctgactgtgacacacaggttgaacttcagtttcaattaaatcgattacccctctgtgaaatgcactatgcactagacaggatcaaggacaatggggttttgtttccagacatcagtatgactcccaccataccatggagtcctaacagacaatgggatgaacagttggatcctcgactaaatgcaaaacagaaagaggctgttctggccattaccactccacttgcaatccagctgccgcctgtgcttatcatcggaccctatgggacaggcaaaacgttcactctagctcaggctgtcaaacatattctgcagcaacaggagactaggattctcatttgcacccattctaatagtgctgctgatctctacataaaggattatttacatccatatgtagaagcaggcaatccccaggcaagacctctcagggtatatttcagaaatcgctgggtaaagactgtccacccagttgtgcatcagtactgtttgatctcaagcgcacattccacctttcagatgccccagaaagaagatattcttaaacatcgagtggtggttgttaccttgaatacttcccagtacctctgtcagttggaccttgaacctgggttttttacacacattctattagatgaagctgcccaggccatggagtgtgaaaccattatgcctctagcattagcaactcaaaacactcggattgtcttggctggtgatcacatgcagctcagtccttttgtttacagcgagtttgccagggagagaaaccttcacgtttcattacttgaccgactctatgagcattaccctgctgagttcccatgtaggattctcctgtgtgagaactaccgctcccatgaagctatcatcaattatacctctgagcttttctatgagggcaaactgatggccagtgggaagcagccagcacacaaagatttctacccactaactttctttacagcacgaggagaagatgtacaagaaaaaaatagcacagctttttataataatgcagaggtgtttgaagtggtggaacgtgtagaagagttaagaaggaagtggccagtagcgtgggggaagttagatgatggcagtattggtgtggtgactccatatgctgatcaagtgtttagaatacgtgctgaacttcgaaaaaagagattatctgatgttaatgtagaaagggtgctaaatgttcaaggaaagcaattcagagttttgtttcttagcacagtacgtacaagacatacttgtaaacataaacagacaccaattaaaaagaaagagcaacttctggaagattccacagaggacttagattatggttttttatctaactacaagcttctcaatactgccatcacaagagcacaatccctggttgctgtggtgggtgatcccattgctctgtgctctattggaagatgcaggaaattttgggaacggtttattgccctgtgtcatgaaaacagtagcctacatggaatcacttttgaacagatcaaagcccagttagaggctttagaactaaagaagacatatgtgttgaatccgctggcacctgaatttatcccccgggctctaagactgcagcattcaggaagtaccaacaaacagcagcaatcaccacccaaggggaaaagtcttcatcatacccagaatgatcacttccagaatgatggaattgttcagcccaatccttctgtacttattggcaatcctattagagcatatactcctccaccccctcttggacctcacccaaatttgggaaaatctccaagccctgttcaaagaatagatcctcacactgggacaagtattctttatgtacctgctgtctatggagggaatgtagttatgtcggtgcctttacctgtaccatggacaggataccagggtaggtttgcagttgatcctcgaattattacacatcaggcagcaatggcctataacatgaacctattacagacacatggacgaggatctcctattccttatggccttggacatcacccacctgtcaccataggccagccacaaaatcagcatcaggagaaggatcaacatgagcaaaatcgaaatggtaaaagtgatacaaataattccggacctgaaattaataagattcgaacaccagagaaaaagccaacagaaccaaaacaggttgatttggaatcaaatccacagaacagaagtcctgaatcacgtcctagtgttgtttatcccagtaccaaatttcctcgcaaagataatctcaacccaagacacataaatcttccccttcctgctccccacgcacagtatgcaatccctaatcgccactttcatccccttccccagctaccaagaccaccctttccaattccacagcagcacaccttgttaaatcagcagcagaataatttgcctgaacaaccaaatcagataccacctcagccaaatcaggtagtccagcagcaaagtcagttgaatcagcagcctcagcagccacctcctcagctttctcctgcatatcaggcgggacccaacaatgctttttttaatagtgcagttgctcatcggccacagtctcctcctgcagaagctgtaattccggagcagcagccccctcccatgctgcaagaaggccacagtcctctgagagccattgcacaacccggccccattcttccttcacatctgaatagcttcattgatgagaacccctcgggattacctataggggaggctttagatcgtatacatgggagtgtcgctctggaaacattaaggcagcagcaggcacggttccagcagtggagcgagcatcatgcctttctcagtcagggcagcgttccatacccacaccatcaccatcctcacctccagcatcttcctcagccgcccctgggattacatcagccgccagtgcgggcagactggaagctcaccagcagtgccgaagatgaagtggagaccacatactcaaggtttcaagacttaatcagagaactgtctcatcgtgatcaaagtgaaacacgggaactagctgaaatgccaccacctcaatcaagacttttgcaatatagacaagtacagagtagaagcccaccagcagtcccatctcccccatccagtacagaccacagtagccacttttctaactttaatgataacagcagagacattgaagtagccagcaacccagcatttccacagcgcctcccaccccagatattcaactcacctttctcgttgccatctgaacaccttgcccctcctcccttgaaatacctggcacctgatggagcatggacttttgctaacttgcaacagaatcacctaatggggccaggttttccctatggcctacctccattgcctcacaggccaccgcagaacccttttgtacaaatacagaatcatcaacatgctattggtcaagagccatttcacccattgtcatctcgaacagtatcttcttcttcgctccctagcttagaagaggtaaatgtcttcttattttccttttgttattagctgattgtgaaaaatatcagtatttattgatttgataataggaaggcacagatcttattgaatttaacagcgtattaaagataatcctttcttgggaattatt

SEQ ID NO: 358147 - DNA, 1925 bp, Homo sapiens
tggggacgttgacaagtggatccaagatggcgtagaaagtaatgacaggatttggatgaagtaatggatcactaatgaactacagtgctggtgagatgtgtaagaaattataaagagctctgatgggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcacaatcgagagtcttctctacagaattgcctcatttttgcaactgaaaaattatgtgcaagctgatgaagattgtagacatgtgctgggagaaggactggccaagggagaagatgcctttcgggcagtgctttgctgcatgcagctgaaagggaagctccaacctgtatccaccattcttgccaagtcactcacaggagagtccctgaatgggatggtaacaaaggatttgacaagactaaaaacacttctctcagaaacagagatttttagaacaaggaatctgtaggtatggtgcccagtgtacttcagcacattcccaggaagaactagcagaatggcagaaaagatatgcttcacggctgataaaattgaaacagcaaaatgagaataaacagctctcaggcagttacatggaaaccttgatagaaaagtggatgaattcattgtctcctgagaaagtgcttagtgaatgtatagaaggagtaaaggtagagcacaatcctgacctgtcagttactgtcagcaccaaaaaatcccaccagacatggacctttgctctcacttgtaagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaagatctcgaatacctgatgcatgcaaaacagcagctagtaaccacagctaaacgttgggattcttcctctaagactattatagattttgaacctaatgaaactactgatttggagaagagccttcttatcagataccaaattcccctctctgctgaccagctatttactcagtccgttttagacaaatcattgaccaagagcaactatcagtcacggttacatgaccttctttatattgaggagatagcccagtataaagaaatcagcaaagatgggattttgccatgttgcccagggaagatctggaactcctgggctcaagtgatccacccgctctggcctcccaaggtgctgggattacaggcatgagccaccgcccctggcccagtttgtgtgatctatctggagagctgtttggcagtttgtatccaggaccttaagtttgaatcttttggtgtggaaattccacatatgggggatcataagcaataatcagagtcaaagatgtctggacacatgtcttgcaaagagtagtgaagaataagttaattatgatatagctatatgattgaatgttatacaacttgaaattatgttcttgaagaatttttaatgcagtgatgatgctcatgatataatattagggaagaaaatatgctagttataataccttattgccattctaattttttatagatgcctatacacatacg

SEQ ID NO: 358148 - DNA, 411 bp, Homo sapiens
tatagatgctatgctatttcagtggttttaatggttcactgaaattcacgatactcgtgtgttatgttctatttattaacgagatgcatgtgtttaacataaatttttattttccatagacaatgggatgaacagttggatcctcgactaaatgcaaaacagaaagaggctgttctggccattaccactccacttgcaatccagctgccgcctgtgcttatcatcggaccctatgggacaggcaaaacgttcactctagctcaggctgtcaaacatattctgcagcaacaggagactaggtgagagggtgggaagcgtgctcatatttccctggtaggatactacctctgttcttgttttaaatacacaatgagggctagcaagacagttttcatgcagctcttaaacatg

SEQ ID NO: 358149 - DNA, 248 bp, Homo sapiens
aaggtggagagcaactgaatttgaatcttctgcagttaaaaaaggcttcttctttttttctaggttgatttggaatcaaatccacagaacagaagtcctgaatcacgtcctagtgttgtttatcccagtaccaaatttcctcgcaaagataatctcaacccaagacacataaatcttccccttcctgctccccacgcacagtatgcaatccctaatcgccactttcatccccttccccagctaccaag

SEQ ID NO: 358150 - DNA, 351 bp, Homo sapiens
tgagagcctcacaaatatgttttccatatttaattatagtttaacgtagaaaaaaacaaaaatcattggcaacatattaatgttattaaaaatttctgagtattccaacttcacctttgttttaatattgaaaatgttcaagtttagttcagcatcaacgttattcttgtttaaaaaattctttcatttggaaaattgcagacagcaactagtaacgccctctctggatatcacgtggaagacttagatgagggtaagtgccaaatgctgtgtaacttctggtagctgtgaataagggctttgcttttattaattattgggagaaaatttactgagttacagtacatataa

SEQ ID NO: 358151 - DNA, 362 bp, Homo sapiens
aattattttaacttccttgtagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaaggtaatatttagacttttttcccccgatacaatgtgttaaaaa

SEQ ID NO: 358152 - DNA, 7265 bp, Homo sapiens
tggggacgttgacaagtggatccaagatggcgtagaaagtaatgacaggatttggatgaagtaatggatcactaatgaactacagtgctggtgagatgtgtaagaaattataaagagctctgatgggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcacaatcgagagtcttctctacagaattgcctcatttttgcaactgaaaaattatgtgcaagctgatgaagattgtagacatgtgctgggagaaggactggccaagggagaagatgcctttcgggcagtgctttgctgcatgcagctgaaagggaagctccaacctgtatccaccattcttgccaagtcactcacaggagagtccctgaatgggatggtaacaaaggatttgacaagactaaaaacacttctctcagaaacagagacagcaactagtaacgccctctctggatatcacgtggaagacttagatgaggggtcttgtaatggttggcatttccgcccaccacctaggggaatcacaagcagcgaggaatatactttgtgtaaaagatttttagaacaaggaatctgtaggtatggtgcccagtgtacttcagcacattcccaggaagaactagcagaatggcagaaaagatatgcttcacggctgataaaattgaaacagcaaaatgagaataaacagctctcaggcagttacatggaaaccttgatagaaaagtggatgaattcattgtctcctgagaaagtgcttagtgaatgtatagaaggagtaaaggtagagcacaatcctgacctgtcagttactgtcagcaccaaaaaatcccaccagacatggacctttgctctcacttgtaagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaagatctcgaatacctgatgcatgcaaaacagcagctagtaaccacagctaaacgttgggattcttcctctaagactattatagattttgaacctaatgaaactactgatttggagaagagccttcttatcagataccaaattcccctctctgctgaccagctatttactcagtccgttttagacaaatcattgaccaagagcaactatcagtcacggttacatgaccttctttatattgaggagatagcccagtataaagaaatcagcaagttcaaccttaaagtgcaattgcagattctggcaagcttcatgctcactggtgtttctggaggtgcaaagtatgctcagaatggacaactttttggtcgctttaagcttactgaaacactttctgaagatactttggctggacgactggtgatgaccaaagtcaatgctgtttatttattaccagtccctaaacagaagttagtacagacccagggaaccaaagagaaggtttatgaagctactattgaagaaaaaacaaaggaatatatatttttaaggctatctagggaatgctgtgaagaacttaatcttcggcctgactgtgacacacaggttgaacttcagtttcaattaaatcgattacccctctgtgaaatgcactatgcactagacaggatcaaggacaatggggttttgtttccagacatcagtatgactcccaccataccatggagtcctaacagacaatgggatgaacagttggatcctcgactaaatgcaaaacagaaagaggctgttctggccattaccactccacttgcaatccagctgccgcctgtgcttatcatcggaccctatgggacaggcaaaacgttcactctagctcaggctgtcaaacatattctgcagcaacaggagactaggattctcatttgcacccattctaatagtgctgctgatctctacataaaggattatttacatccatatgtagaagcaggcaatccccaggcaagacctctcagggtatatttcagaaatcgctgggtaaagactgtccacccagttgtgcatcagtactgtttgatctcaagcgcacattccacctttcagatgccccagaaagaagatattcttaaacatcgagtggtggttgttaccttgaatacttcccagtacctctgtcagttggaccttgaacctgggttttttacacacattctattagatgaagctgcccaggccatggagtgtgaaaccattatgcctctagcattagcaactcaaaacactcggattgtcttggctggtgatcacatgcagctcagtccttttgtttacagcgagtttgccagggagagaaaccttcacgtttcattacttgaccgactctatgagcattaccctgctgagttcccatgtaggattctcctgtgtgagaactaccgctcccatgaagctatcatcaattatacctctgagcttttctatgagggcaaactgatggccagtgggaagcagccagcacacaaagatttctacccactaactttctttacagcacgaggagaagatgtacaagaaaaaaatagcacagctttttataataatgcagaggtgtttgaagtggtggaacgtgtagaagagttaagaaggaagtggccagtagcgtgggggaagttagatgatggcagtattggtgtggtgactccatatgctgatcaagtgtttagaatacgtgctgaacttcgaaaaaagagattatctgatgttaatgtagaaagggtgctaaatgttcaaggaaagcaattcagagttttgtttcttagcacagtacgtacaagacatacttgtaaacataaacagacaccaattaaaaagaaagagcaacttctggaagattccacagaggacttagattatggttttttatctaactacaagcttctcaatactgccatcacaagagcacaatccctggttgctgtggtgggtgatcccattgctctgtgctctattggaagatgcaggaaattttgggaacggtttattgccctgtgtcatgaaaacagtagcctacatggaatcacttttgaacagatcaaagcccagttagaggctttagaactaaagaagacatatgtgttgaatccgctggcacctgaatttatcccccgggctctaagactgcagcattcaggaagtaccaacaaacagcagcaatcaccacccaaggggaaaagtcttcatcatacccagaatgatcacttccagaatgatggaattgttcagcccaatccttctgtacttattggcaatcctattagagcatatactcctccaccccctcttggacctcacccaaatttgggaaaatctccaagccctgttcaaagaatagatcctcacactgggacaagtattctttatgtacctgctgtctatggagggaatgtagttatgtcggtgcctttacctgtaccatggacaggataccagggtaggtttgcagttgatcctcgaattattacacatcaggcagcaatggcctataacatgaacctattacagacacatggacgaggatctcctattccttatggccttggacatcacccacctgtcaccataggccagccacaaaatcagcatcaggagaaggatcaacatgagcaaaatcgaaatggtaaaagtgatacaaataattccggacctgaaattaataagattcgaacaccagagaaaaagccaacagaaccaaaacaggttgatttggaatcaaatccacagaacagaagtcctgaatcacgtcctagtgttgtttatcccagtaccaaatttcctcgcaaagataatctcaacccaagacacataaatcttccccttcctgctccccacgcacagtatgcaatccctaatcgccactttcatccccttccccagctaccaagaccaccctttccaattccacagcagcacaccttgttaaatcagcagcagaataatttgcctgaacaaccaaatcagataccacctcagccaaatcaggtagtccagcagcaaagtcagttgaatcagcagcctcagcagccacctcctcagctttctcctgcatatcaggcgggacccaacaatgctttttttaatagtgcagttgctcatcggccacagtctcctcctgcagaagctgtaattccggagcagcagccccctcccatgctgcaagaaggccacagtcctctgagagccattgcacaacccggccccattcttccttcacatctgaatagcttcattgatgagaacccctcgggattacctataggggaggctttagatcgtatacatgggagtgtcgctctggaaacattaaggcagcagcaggcacggttccagcagtggagcgagcatcatgcctttctcagtcagggcagcgttccatacccacaccatcaccatcctcacctccagcatcttcctcagccgcccctgggattacatcagccgccagtgcgggcagactggaagctcaccagcagtgccgaagatgaagtggagaccacatactcaaggtttcaagacttaatcagagaactgtctcatcgtgatcaaagtgaaacacgggaactagctgaaatgccaccacctcaatcaagacttttgcaatatagacaagtacagagtagaagcccaccagcagtcccatctcccccatccagtacagaccacagtagccacttttctaactttaatgataacagcagagacattgaagtagccagcaacccagcatttccacagcgcctcccaccccagatattcaactcacctttctcgttgccatctgaacaccttgcccctcctcccttgaaatacctggcacctgatggagcatggacttttgctaacttgcaacagaatcacctaatggggccaggttttccctatggcctacctccattgcctcacaggccaccgcagaacccttttgtacaaatacagaatcatcaacatgctattggtcaagagccatttcacccattgtcatctcgaacagtatcttcttcttcgctccctagcttagaagagtatgagcccagaggacctggtcggcccttgtaccaaagaagaatctcatctagctcagttcaaccttgttctgaagaagtaagcactcctcaagacagtctggctcagtgtaaagagcttcaggaccacagtaaccaatcttctttcaacttttcatccccggagtcctgggtaaacaccacctcatctactccttatcagaacattccgtgcaatggatccagcaggacagctcagcccagagagttgatagcgccacccaagactgtcaaaccccctgaggatcaactgaagtcggagaacctcgaggtgtccagttccttcaactacagtgtgctgcagcatcttggccagtttccaccccttatgcctaacaagcagatcgcggagtcggccaatagcagtagcccccagagctctgcggggggcaagcccgccatgtcctatgccagcgctctgcgggcccctccaaagcccaggccccctcctgagcaggccaagaagagtagcgaccctctgtctctcttccaggaactgagcctagggagctcatctggcagcaatggcttttactcatattttaaataatcactttttttttccctcaagggagaatgttttaatttctgtttgtatcagtagaattaaggtagttggacttcatctatagatgcacagttccctttgttttaatattaaatatgttctcacttaattgctttgctgctagacttgcaactaatttttttaaagtatattccattattttgcatttttgatgtgtcaaaactttgacagcttttatgtagaataaaaaaatttttaaatttgtgtattgttacatatgtttgcatcaagctagcagccaagaggttaattgtgcaactataaaaaaaaaaaaaaaaagaaaagttggtctaaaatgtatttaaaaagaaaaaaaaattggtaagtagcatttacatttattcaataatattaccacatgcggggtttctgtaccagaaatggccagttgatgtacaaatgtatgttatttttgcttaaattcatttaaattttttttaaaataaaggggcagcatcttctaaataagttttatcagctttttttttttttttggtgacacgatgctgcattctaaaacttttatagttttagactatgtatgatgtgttgttgtaatctccatccaccataggatagagttaaaggcattctttgcaggcatattttgtatgccactgttttttgaaatgtgaaaaaaacgttggcatacttagttattttttggacaagctacacttcaagcttgtttttaatgttaatttgatagtgtgtgtttttttttttaaacaaatcaagaagctgaaaaatttttaggattgttggtgcttagtagacttgataactattttaaaaatgcgtgaatttagtaaaattctttttttctcactatgcatgtgtaaatgtttgtaacctggcttccctcttctccagtggtataaagaattgtgccgctttaaggtttgggtttttttctctccagtaaaaattttggtaccttatttgatgtttacattaaaatgtgacattatacgtggcaattcaaatattttgctagctgtcttgtttgaggaacaccattaaagaagaaatataatgtttgtcaaaaatgtatcaaaattcatcagaatctggggcagaaaactacccttgtttttcatgtctttcaattcttctaaaataccccttattgaacttgtacacaatataaaatttaaatagccatcttaaatattctaccatctaaaaattgctttgaatgaattttggtaaaatcca

SEQ ID NO: 358153 - DNA, 7115 bp, Homo sapiens
tggggacgttgacaagtggatccaagatggcgtagaaagtaatgacaggatttggatgaagtaatggatcactaatgaactacagtgctggtgagatgtgtaagaaattataaagagctctgatgggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcacaatcgagagtcttctctacagaattgcctcatttttgcaactgaaaaattatgtgcaagctgatgaagattgtagacatgtgctgggagaaggactggccaagggagaagatgcctttcgggcagtgctttgctgcatgcagctgaaagggaagctccaacctgtatccaccattcttgccaagtcactcacaggagagtccctgaatgggatggtaacaaaggatttgacaagactaaaaacacttctctcagaaacagagacagcaactagtaacgccctctctggatatcacgtggaagacttagatgaggggtcttgtaatggttggcatttccgcccaccacctaggggaatcacaagcagcgaggaatatactttgtgtaaaagatttttagaacaaggaatctgtaggtatggtgcccagtgtacttcagcacattcccaggaagaactagcagaatggcagaaaagatatgcttcacggctgataaaattgaaacagcaaaatgagaataaacagctctcaggcagttacatggaaaccttgatagaaaagtggatgaattcattgtctcctgagaaagtgcttagtgaatgtatagaaggagtaaaggtagagcacaatcctgacctgtcagttactgtcagcaccaaaaaatcccaccagacatggacctttgctctcacttgtaagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaagatctcgaatacctgatgcatgcaaaacagcagctagtaaccacagctaaacgttgggattcttcctctaagactattatagattttgaacctaatgaaactactgatttggagaagagccttcttatcagataccaaattcccctctctgctgaccagctatttactcagtccgttttagacaaatcattgaccaagagcaactatcagtcacggttacatgaccttctttatattgaggagatagcccagtataaagaaatcagcaagttcaaccttaaagtgcaattgcagattctggcaagcttcatgctcactggtgtttctggaggtgcaaagtatgctcagaatggacaactttttggtcgctttaagcttactgaaacactttctgaagatactttggctggacgactggtgatgaccaaagtcaatgctgtttatttattaccagtccctaaacagaagttagtacagacccagggaaccaaagagaaggtttatgaagctactattgaagaaaaaacaaaggaatatatatttttaaggctatctagggaatgctgtgaagaacttaatcttcggcctgactgtgacacacaggttgaacttcagtttcaattaaatcgattacccctctgtgaaatgcactatgcactagacaggatcaaggacaatggggttttgtttccagacatcagtatgactcccaccataccatggagtcctaacagacaatgggatgaacagttggatcctcgactaaatgcaaaacagaaagaggctgttctggccattaccactccacttgcaatccagctgccgcctgtgcttatcatcggaccctatgggacaggcaaaacgttcactctagctcaggctgtcaaacatattctgcagcaacaggagactaggattctcatttgcacccattctaatagtgctgctgatctctacataaaggattatttacatccatatgtagaagcaggcaatccccaggcaagacctctcagggtatatttcagaaatcgctgggtaaagactgtccacccagttgtgcatcagtactgtttgatctcaagcgcacattccacctttcagatgccccagaaagaagatattcttaaacatcgagtggtggttgttaccttgaatacttcccagtacctctgtcagttggaccttgaacctgggttttttacacacattctattagatgaagctgcccaggccatggagtgtgaaaccattatgcctctagcattagcaactcaaaacactcggattgtcttggctggtgatcacatgcagctcagtccttttgtttacagcgagtttgccagggagagaaaccttcacgtttcattacttgaccgactctatgagcattaccctgctgagttcccatgtaggattctcctgtgtgagaactaccgctcccatgaagctatcatcaattatacctctgagcttttctatgagggcaaactgatggccagtgggaagcagccagcacacaaagatttctacccactaactttctttacagcacgaggagaagatgtacaagaaaaaaatagcacagctttttataataatgcagaggtgtttgaagtggtggaacgtgtagaagagttaagaaggaagtggccagtagcgtgggggaagttagatgatggcagtattggtgtggtgactccatatgctgatcaagtgtttagaatacgtgctgaacttcgaaaaaagagattatctgatgttaatgtagaaagggtgctaaatgttcaaggaaagcaattcagagttttgtttcttagcacagtacgtacaagacatacttgtaaacataaacagacaccaattaaaaagaaagagcaacttctggaagattccacagaggacttagattatggttttttatctaactacaagcttctcaatactgccatcacaagagcacaatccctggttgctgtggtgggtgatcccattgctctgtgctctattggaagatgcaggaaattttgggaacggtttattgccctgtgtcatgaaaacagtagcctacatggaatcacttttgaacagatcaaagcccagttagaggctttagaactaaagaagacatatgtgttgaatccgctggcacctgaatttatcccccgggctctaagactgcagcattcaggaagtaccaacaaacagcagcaatcaccacccaaggggaaaagtcttcatcatacccagaatgatcacttccagaatgatggaattgttcagcccaatccttctgtacttattggcaatcctattagagcatatactcctccaccccctcttggacctcacccaaatttgggaaaatctccaagccctgttcaaagaatagatcctcacactgggacaagtattctttatgtacctgctgtctatggagggaatgtagttatgtcggtgcctttacctgtaccatggacaggataccagggtaggtttgcagttgatcctcgaattattacacatcaggcagcaatggcctataacatgaacctattacagacacatggacgaggatctcctattccttatggccttggacatcacccacctgtcaccataggccagccacaaaatcagcatcaggagaaggatcaacatgagcaaaatcgaaatggtaaaagtgatacaaataattccggacctgaaattaataagattcgaacaccagagaaaaagccaacagaaccaaaacaggttgatttggaatcaaatccacagaacagaagtcctgaatcacgtcctagtgttgtttatcccagtaccaaatttcctcgcaaagataatctcaacccaagacacataaatcttccccttcctgctccccacgcacagtatgcaatccctaatcgccactttcatccccttccccagctaccaagaccaccctttccaattccacagcagcacaccttgttaaatcagcagcagaataatttgcctgaacaaccaaatcagataccacctcagccaaatcaggtagtccagcagcaaagtcagttgaatcagcagcctcagcagccacctcctcagctttctcctgcatatcaggcgggacccaacaatgctttttttaatagtgcagttgctcatcggccacagtctcctcctgcagaagctgtaattccggagcagcagccccctcccatgctgcaagaaggccacagtcctctgagagccattgcacaacccggccccattcttccttcacatctgaatagcttcattgatgagaacccctcgggattacctataggggaggctttagatcgtatacatgggagtgtcgctctggaaacattaaggcagcagcaggcacggttccagcagtggagcgagcatcatgcctttctcagtcagggcagcgttccatacccacaccatcaccatcctcacctccagcatcttcctcagccgcccctgggattacatcagccgccagtgcgggcagactggaagctcaccagcagtgccgaagatgaagtggagaccacatactcaaggtttcaagacttaatcagagaactgtctcatcgtgatcaaagtgaaacacgggaactagctgaaatgccaccacctcaatcaagacttttgcaatatagacaagtacagagtagaagcccaccagcagtcccatctcccccatccagtacagaccacagtagccacttttctaactttaatgataacagcagagacattgaagtagccagcaacccagcatttccacagcgcctcccaccccagatattcaactcacctttctcgttgccatctgaacaccttgcccctcctcccttgaaatacctggcacctgatggagcatggacttttgctaacttgcaacagaatcacctaatggggccaggttttccctatggcctacctccattgcctcacaggccaccgcagaacccttttgtacaaatacagaatcatcaacatgctattggtcaagagccatttcacccattgtcatctcgaacagtatcttcttcttcgctccctagcttagaagagtatgagcccagaggacctggtcggcccttgtaccaaagaagaatctcatctagctcagttcaaccttgttctgaagaagtaagcactcctcaagacagtctggctcagtgtaaagagcttcaggaccacagtaaccaatcttctttcaacttttcatccccggagtcctgggtaaacaccacctcatctactccttatcagaacattccgtgcaatggatccagcaggacagctcagcccagagagttgatagcgccacccaagactgtcaaaccccctgaggatcaactgaagtcggagaacctcgaggtgtccagttccttcaactacagtgtgctgcagcatcttggccagtttccaccccttatgcctaacaagcagatcgcggagtcggccaatagcagtagcccccagagctctgcggggggcaagcccgccatgtcctatgccagcgctctgcgggcccctccaaagcccaggccccctcctgagcaggccaagaagagtagcgaccctctgtctctcttccaggaactgagcctagggagctcatctggcagcaatggcttttactcatattttaaataatcactttttttttccctcaagggagaatgttttaatttctgtttgtatcagtagaattaaggtagttggacttcatctatagatgcacagttccctttgttttaatattaaatatgttctcacttaattgctttgctgctagacttgcaactaatttttttaaagtatattccattattttgcatttttgatgtgtcaaaactttgacagcttttatgtagaataaaaaaatttttaaatttgtgtattgttacatatgtttgcatcaagctagcagccaagaggttaattgtgcaactataaaaaaaaaaaaaaaaagaaaagttggtctaaaatgtatttaaaaagaaaaaaaaattggtaagtagcatttacatttattcaataatattaccacatgcggggtttctgtaccagaaatggccagttgatgtacaaatgtatgttatttttgcttaaattcatttaaattttttttaaaataaaggggcagcatcttctaaataagttttatcagctttttttttttttttggtgacacgatgctgcattctaaaacttttatagttttagactatgtatgatgtgttgttgtaatctccatccaccataggatagagttaaaggcattctttgcaggcatattttgtatgccactgttttttgaaatgtgaaaaaaacgttggcatacttagttattttttggacaagctacacttcaagcttgtttttaatgttaatttgatagtgtgtgtttttttttttaaacaaatcaagaagctgaaaaatttttaggattgttggtgcttagtagacttgataactattttaaaaatgcgtgaatttagtaaaattctttttttctcactatgcatgtgtaaatgtttgtaacctggcttccctcttctccagtggtataaagaattgtgccgctttaaggtttgggtttttttctctccagtaaaaattttggtaccttatttgatgtttacattaaaatgtgacattatacgtggcaattcaaatattttgctagctgtcttgtttttggggaaacccctttttatgaaagaaaatttttaggggttgtgctcaaaaatgggtttc

SEQ ID NO: 358154 - DNA, 7137 bp, Homo sapiens
tggggacgttgacaagtggatccaagatggcgtagaaagtaatgacaggatttggatgaagtaatggatcactaatgaactacagtgctggtgagatgtgtaagaaattataaagagctctgatgggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcacaatcgagagtcttctctacagaattgcctcatttttgcaactgaaaaattatgtgcaagctgatgaagattgtagacatgtgctgggagaaggactggccaagggagaagatgcctttcgggcagtgctttgctgcatgcagctgaaagggaagctccaacctgtatccaccattcttgccaagtcactcacaggagagtccctgaatgggatggtaacaaaggatttgacaagactaaaaacacttctctcagaaacagagatttttagaacaaggaatctgtaggtatggtgcccagtgtacttcagcacattcccaggaagaactagcagaatggcagaaaagatatgcttcacggctgataaaattgaaacagcaaaatgagaataaacagctctcaggcagttacatggaaaccttgatagaaaagtggatgaattcattgtctcctgagaaagtgcttagtgaatgtatagaaggagtaaaggtagagcacaatcctgacctgtcagttactgtcagcaccaaaaaatcccaccagacatggacctttgctctcacttgtaagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaagatctcgaatacctgatgcatgcaaaacagcagctagtaaccacagctaaacgttgggattcttcctctaagactattatagattttgaacctaatgaaactactgatttggagaagagccttcttatcagataccaaattcccctctctgctgaccagctatttactcagtccgttttagacaaatcattgaccaagagcaactatcagtcacggttacatgaccttctttatattgaggagatagcccagtataaagaaatcagcaagttcaaccttaaagtgcaattgcagattctggcaagcttcatgctcactggtgtttctggaggtgcaaagtatgctcagaatggacaactttttggtcgctttaagcttactgaaacactttctgaagatactttggctggacgactggtgatgaccaaagtcaatgctgtttatttattaccagtccctaaacagaagttagtacagacccagggaaccaaagagaaggtttatgaagctactattgaagaaaaaacaaaggaatatatatttttaaggctatctagggaatgctgtgaagaacttaatcttcggcctgactgtgacacacaggttgaacttcagtttcaattaaatcgattacccctctgtgaaatgcactatgcactagacaggatcaaggacaatggggttttgtttccagacatcagtatgactcccaccataccatggagtcctaacagacaatgggatgaacagttggatcctcgactaaatgcaaaacagaaagaggctgttctggccattaccactccacttgcaatccagctgccgcctgtgcttatcatcggaccctatgggacaggcaaaacgttcactctagctcaggctgtcaaacatattctgcagcaacaggagactaggattctcatttgcacccattctaatagtgctgctgatctctacataaaggattatttacatccatatgtagaagcaggcaatccccaggcaagacctctcagggtatatttcagaaatcgctgggtaaagactgtccacccagttgtgcatcagtactgtttgatctcaagcgcacattccacctttcagatgccccagaaagaagatattcttaaacatcgagtggtggttgttaccttgaatacttcccagtacctctgtcagttggaccttgaacctgggttttttacacacattctattagatgaagctgcccaggccatggagtgtgaaaccattatgcctctagcattagcaactcaaaacactcggattgtcttggctggtgatcacatgcagctcagtccttttgtttacagcgagtttgccagggagagaaaccttcacgtttcattacttgaccgactctatgagcattaccctgctgagttcccatgtaggattctcctgtgtgagaactaccgctcccatgaagctatcatcaattatacctctgagcttttctatgagggcaaactgatggccagtgggaagcagccagcacacaaagatttctacccactaactttctttacagcacgaggagaagatgtacaagaaaaaaatagcacagctttttataataatgcagaggtgtttgaagtggtggaacgtgtagaagagttaagaaggaagtggccagtagcgtgggggaagttagatgatggcagtattggtgtggtgactccatatgctgatcaagtgtttagaatacgtgctgaacttcgaaaaaagagattatctgatgttaatgtagaaagggtgctaaatgttcaaggaaagcaattcagagttttgtttcttagcacagtacgtacaagacatacttgtaaacataaacagacaccaattaaaaagaaagagcaacttctggaagattccacagaggacttagattatggttttttatctaactacaagcttctcaatactgccatcacaagagcacaatccctggttgctgtggtgggtgatcccattgctctgtgctctattggaagatgcaggaaattttgggaacggtttattgccctgtgtcatgaaaacagtagcctacatggaatcacttttgaacagatcaaagcccagttagaggctttagaactaaagaagacatatgtgttgaatccgctggcacctgaatttatcccccgggctctaagactgcagcattcaggaagtaccaacaaacagcagcaatcaccacccaaggggaaaagtcttcatcatacccagaatgatcacttccagaatgatggaattgttcagcccaatccttctgtacttattggcaatcctattagagcatatactcctccaccccctcttggacctcacccaaatttgggaaaatctccaagccctgttcaaagaatagatcctcacactgggacaagtattctttatgtacctgctgtctatggagggaatgtagttatgtcggtgcctttacctgtaccatggacaggataccagggtaggtttgcagttgatcctcgaattattacacatcaggcagcaatggcctataacatgaacctattacagacacatggacgaggatctcctattccttatggccttggacatcacccacctgtcaccataggccagccacaaaatcagcatcaggagaaggatcaacatgagcaaaatcgaaatggtaaaagtgatacaaataattccggacctgaaattaataagattcgaacaccagagaaaaagccaacagaaccaaaacaggttgatttggaatcaaatccacagaacagaagtcctgaatcacgtcctagtgttgtttatcccagtaccaaatttcctcgcaaagataatctcaacccaagacacataaatcttccccttcctgctccccacgcacagtatgcaatccctaatcgccactttcatccccttccccagctaccaagaccaccctttccaattccacagcagcacaccttgttaaatcagcagcagaataatttgcctgaacaaccaaatcagataccacctcagccaaatcaggtagtccagcagcaaagtcagttgaatcagcagcctcagcagccacctcctcagctttctcctgcatatcaggcgggacccaacaatgctttttttaatagtgcagttgctcatcggccacagtctcctcctgcagaagctgtaattccggagcagcagccccctcccatgctgcaagaaggccacagtcctctgagagccattgcacaacccggccccattcttccttcacatctgaatagcttcattgatgagaacccctcgggattacctataggggaggctttagatcgtatacatgggagtgtcgctctggaaacattaaggcagcagcaggcacggttccagcagtggagcgagcatcatgcctttctcagtcagggcagcgttccatacccacaccatcaccatcctcacctccagcatcttcctcagccgcccctgggattacatcagccgccagtgcgggcagactggaagctcaccagcagtgccgaagatgaagtggagaccacatactcaaggtttcaagacttaatcagagaactgtctcatcgtgatcaaagtgaaacacgggaactagctgaaatgccaccacctcaatcaagacttttgcaatatagacaagtacagagtagaagcccaccagcagtcccatctcccccatccagtacagaccacagtagccacttttctaactttaatgataacagcagagacattgaagtagccagcaacccagcatttccacagcgcctcccaccccagatattcaactcacctttctcgttgccatctgaacaccttgcccctcctcccttgaaatacctggcacctgatggagcatggacttttgctaacttgcaacagaatcacctaatggggccaggttttccctatggcctacctccattgcctcacaggccaccgcagaacccttttgtacaaatacagaatcatcaacatgctattggtcaagagccatttcacccattgtcatctcgaacagtatcttcttcttcgctccctagcttagaagagtatgagcccagaggacctggtcggcccttgtaccaaagaagaatctcatctagctcagttcaaccttgttctgaagaagtaagcactcctcaagacagtctggctcagtgtaaagagcttcaggaccacagtaaccaatcttctttcaacttttcatccccggagtcctgggtaaacaccacctcatctactccttatcagaacattccgtgcaatggatccagcaggacagctcagcccagagagttgatagcgccacccaagactgtcaaaccccctgaggatcaactgaagtcggagaacctcgaggtgtccagttccttcaactacagtgtgctgcagcatcttggccagtttccaccccttatgcctaacaagcagatcgcggagtcggccaatagcagtagcccccagagctctgcggggggcaagcccgccatgtcctatgccagcgctctgcgggcccctccaaagcccaggccccctcctgagcaggccaagaagagtagcgaccctctgtctctcttccaggaactgagcctagggagctcatctggcagcaatggcttttactcatattttaaataatcactttttttttccctcaagggagaatgttttaatttctgtttgtatcagtagaattaaggtagttggacttcatctatagatgcacagttccctttgttttaatattaaatatgttctcacttaattgctttgctgctagacttgcaactaatttttttaaagtatattccattattttgcatttttgatgtgtcaaaactttgacagcttttatgtagaataaaaaaatttttaaatttgtgtattgttacatatgtttgcatcaagctagcagccaagaggttaattgtgcaactataaaaaaaaaaaaaaaaagaaaagttggtctaaaatgtatttaaaaagaaaaaaaaattggtaagtagcatttacatttattcaataatattaccacatgcggggtttctgtaccagaaatggccagttgatgtacaaatgtatgttatttttgcttaaattcatttaaattttttttaaaataaaggggcagcatcttctaaataagttttatcagctttttttttttttttggtgacacgatgctgcattctaaaacttttatagttttagactatgtatgatgtgttgttgtaatctccatccaccataggatagagttaaaggcattctttgcaggcatattttgtatgccactgttttttgaaatgtgaaaaaaacgttggcatacttagttattttttggacaagctacacttcaagcttgtttttaatgttaatttgatagtgtgtgtttttttttttaaacaaatcaagaagctgaaaaatttttaggattgttggtgcttagtagacttgataactattttaaaaatgcgtgaatttagtaaaattctttttttctcactatgcatgtgtaaatgtttgtaacctggcttccctcttctccagtggtataaagaattgtgccgctttaaggtttgggtttttttctctccagtaaaaattttggtaccttatttgatgtttacattaaaatgtgacattatacgtggcaattcaaatattttgctagctgtcttgtttgaggaacaccattaaagaagaaatataatgtttgtcaaaaatgtatcaaaattcatcagaatctggggcagaaaactacccttgtttttcatgtctttcaattcttctaaaataccccttattgaacttgtacacaatataaaatttaaatagccatcttaaatattctaccatctaaaaattgctttgaatgaattttggtaaaatcca

SEQ ID NO: 358155 - DNA, 1463 bp, Homo sapiens
gcggccgcctactactactactgctcgaattcaagcttctaacgatgtacggggacatgtcctatgccagcgctctgcgggcccctccaaagcccaggccccctcctgagcaggccaagaagagtagcgaccctctgtctctcttccaggaactgagcctagggagctcatctggcagcaatggcttttactcatattttaaataatcactttttttttccctcaagggagaatgttttaatttctgtttgtatcagtagaattaaggtagttggacttcatctatagatgcacagttccctttgttttaatattaaatatgttctcacttaattgctttgctgctagacttgcaactaatttttttaaagtatattccattattttgcatttttgatgtgtcaaaactttgacagcttttatgtagaataaaaaaatttttaaatttgtgtattgttacatatgtttgcatcaagctagcagccaagaggttaattgtgcaactataaaaaaaaaaaaaaaaagaaaagttggtctaaaatgtatttaaaaagaaaaaaaaattggtaagtagcatttacatttattcaataatattaccacatgcggggtttctgtaccagaaatggccagttgatgtacaaatgtatgttatttttgcttaaattcatttaaattttttttaaaataaaggggcagcatcttctaaataagttttatcagctttttttttttttttggtgacacgatgctgcattctaaaacttttatagttttagactatgtatgatgtgttgttgtaatctccatccaccataggatagagttaaaggcattctttgcaggcatattttgtatgccactgttttttgaaatgtgaaaaaaacgttggcatacttagttattttttggacaagctacacttcaagcttgtttttaatgttaatttgatagtgtgtgtttttttttttaaacaaatcaagaagctgaaaaatttttaggattgttggtgcttagtagacttgataactattttaaaaatgcgtgaatttagtaaaattctttttttctcactatgcatgtgtaaatgtttgtaacctggcttccctcttctccagtggtataaagaattgtgccgctttaaggtttgggtttttttctctccagtaaaaattttggtaccttatttgatgtttacattaaaatgtgacattatacgtggcaattcaaatattttgctagctgtcttgtttgaggaacaccattaaagaagaaatataatgtttgtcaaaaatgtatcaaaattcatcagaatctggggcagaaaactacccttgtttttcatgtctttcaattcttctaaaataccccttattgaacttgtacacaatataaaatttaaatagccatcttaaatattctaccatctaaaaattgctttgaatgaattttggtaaaatcca

SEQ ID NO: 358156 - DNA, 1314 bp, Homo sapiens
tggggacgttgacaagtggatccaagatggcgtagaaagtaatgacaggatttggatgaagtaatggatcactaatgaactacagtgctggtgagatgtgtaagaaattataaagagctctgatgggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcacaatcgagagtcttctctacagaattgcctcatttttgcaactgaaaaattatgtgcaagctgatgaagattgtagacatgtgctgggagaaggactggccaagggagaagatgcctttcgggcagtgctttgctgcatgcagctgaaagggaagctccaacctgtatccaccattcttgccaagtcactcacaggagagtccctgaatgggatggtaacaaaggatttgacaagactaaaaacacttctctcagaaacagagatttttagaacaaggaatctgtaggtatggtgcccagtgtacttcagcacattcccaggaagaactagcagaatggcagaaaagatatgcttcacggctgataaaattgaaacagcaaaatgagaataaacagctctcaggcagttacatggaaaccttgatagaaaagtggatgaattcattgtctcctgagaaagtgcttagtgaatgtatagaaggagtaaaggtagagcacaatcctgacctgtcagttactgtcagcaccaaaaaatcccaccagacatggacctttgctctcacttgtaagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaaggtaatatttagacttttttcccccgatacaatgtgttaaaaagcaacattcaaagatatgtattggcccctgaatatattccatggataggaagagaatag

SEQ ID NO: 358157 - DNA, 340 bp, Homo sapiens
tctctctgggcagagatgccacttgcctcccccaccatgccatctctgaagaatattacagaccattttggagcatggtgaataagaaattttcaccttaggagttcagttgaatagtcatttttatatttgtgactgcaagtcactcttaggggctgtacttccttagtactggtagcattattatccaatggacttttatagctttcattaggttttctttttttttttgagacagagtctcgctctgtctgtcacccaggctggagtgcagtggcacaatctcggctctctacaagctccgcctcctgggttcacgccattctcctgcgtcagcctc

SEQ ID NO: 358158 - DNA, 4150 bp, Homo sapiens
  misc_feature (12)..(12): n is a, c, g, or t
  misc_feature (4102)..(4102): n is a, c, g, or t
tgggacgacctnggggatacaggcgcccgccacacgcccggctaatttttgtacttttagtagtgacagcctggccaacatggtgaagccccatctctactaaaaatacaaaaattagctgggtgtggtggctcatgcctctagtcccaggtactcaggaggccgaggacagagaattgcttaaacccaggaggcgggggttgcagagattgtgccactgcacttcagcctgggtgacaaagtgatactccatctcaaaaaaaaataaataaaagcattttaacagtattatgtttgtgctttcaatttcaattctaagttacagtttttactaagtttgagtaaatccttgagatggacatagtaggatgaattttgaggagtaatttagcaactatcaggtattttttgttaactgttatagaagaatatgtattcattatagaatataagaaaatatagataatccttagtttttatggtgctggcttgatctgaatttaaattatctcattcctcattttaagaagaggaagaagtgattgttaccaagtaactcacagctgtctgcttcacaatctagttgagattggtttttggtattttttttaagcctttggatttataatctgttatgtcaagaacttgtggcttccttaggtaaggattacttaaattggatcggagttgttttctgttttaggtagctgacttagaaacctactaactaataagtctttaaaatagagaaaaattaacactaaacaactaatccaagttttttcttaaatccaattctgatgtataaattttgaataatattaggttcttaactggaaattaccatttcagggtttgaaaaggactaggtgcgtataaaaagttcagcccctcatctgttagactgattattggtaagactctttcacttagtcagcaagctgtgcaaagcaaatactggtatgcatcctcagcaattgagatttgaaattgtaagcaaaagctattcttttgcattcctgtgtccaaatgtcatcctaaagaacttgctgacttatgccagtttgggttttagagtaagttaactgcttgttatatggcaggtgattggctgatgctgcatttctcctccccaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactggtaagatctttgcatatgatatttggaagacttagagggacagccaattgaatggacagcaagtctaggaagtctgtagtgacactttagaagtattttcctgaccagtaagcattatttctttacatgttcctccagtgttgagaaaaacctaatgcccttttttgtgttaagtttacctattaattttaatttttgtagagatagaacttagatgacggatttaaccttgaagtaggtttgtatttttaaatctatttgctttgattaccacagacagtgattgaggtagatgggcactatctggctgcttatatgaaggttttgaaaccattctgttaatccttttaacaaatggttatctgtccttttctatcttataataaaagattgaagatatgacttagtatgctcattgtactgtttgcttagagatgggaggctattttgatttttcatgctgttctaaatcatgaaagaataggtaactttgtactcatttcttaatttaaatttaagaagcacttgtagattttttgtattggtatttcagatccctattgagttttttaactgaagtcggagcaaatgaattgagcattctgagtacttggctaatcaagtgatgaagaggtagtaatatgaattctgggacctaggcatagatgacctgattctgttctcccctctactgttgaaagacagggcaggtgacttacgtaagggatatttttgtcaggtgccttctcagatattaattagaatccattttcttttactccctcatctggagtatttagcctgctttttaaaaattgtcgtaaagtatacataacataaaaattaccattttaatcatttttaactatatagttctgtggcattaagtacaaccaaactgttgtgtaattattaccactgtccacctccagaacttttcatctccccccaactgaaactttgtaatcatttaatactaactcctcctcctcctctccccccagcccctggcaaccaccattctactttctgattctgaaaatgactgctctaggtacctcatataagtggtatacaatatttgtgcttttgaaactagcttattttacttggcatgtcttaagggttcattcatgttgtagcatgggtcaaaattttcttccttttttaggctgaataatattccattatatatatgaattacgtatttgagtcatgtagatgaattatatacatgaatatatgtatctcctatttatttttaaaggcagcaaattgtattaatgattttgatatatattggcttttaagtataaagactattaccatttaactcttggaccctaaaatcgtttttcttaagcagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358159 - DNA, 4131 bp, Homo sapiens
  misc_feature (4083)..(4083): n is a, c, g, or t
cggactgggtatgcgatggagtctgcgtgatggaaatggtgatactctagactcgatcgtgtgaagcctgatatctagtaacataggtacgtcgtttaacagcgtgttgagtgtcatgcctctagtcccaggtactcaggaggccgaggacagagaattgcttaaacccaggaggcgggggttgcagagattgtgccactgcacttcagcctgggtgacaaagtgatactccatctcaaaaaaaaataaataaaagcattttaacagtattatgtttgtgctttcaatttcaattctaagttacagtttttactaagtttgagtaaatccttgagatggacatagtaggatgaattttgaggagtaatttagcaactatcaggtattttttgttaactgttatagaagaatatgtattcattatagaatataagaaaatatagataatccttagtttttatggtgctggcttgatctgaatttaaattatctcattcctcattttaagaagaggaagaagtgattgttaccaagtaactcacagctgtctgcttcacaatctagttgagattggtttttggtattttttttaagcctttggatttataatctgttatgtcaagaacttgtggcttccttaggtaaggattacttaaattggatcggagttgttttctgttttaggtagctgacttagaaacctactaactaataagtctttaaaatagagaaaaattaacactaaacaactaatccaagttttttcttaaatccaattctgatgtataaattttgaataatattaggttcttaactggaaattaccatttcagggtttgaaaaggactaggtgcgtataaaaagttcagcccctcatctgttagactgattattggtaagactctttcacttagtcagcaagctgtgcaaagcaaatactggtatgcatcctcagcaattgagatttgaaattgtaagcaaaagctattcttttgcattcctgtgtccaaatgtcatcctaaagaacttgctgacttatgccagtttgggttttagagtaagttaactgcttgttatatggcaggtgattggctgatgctgcatttctcctccccaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactggtaagatctttgcatatgatatttggaagacttagagggacagccaattgaatggacagcaagtctaggaagtctgtagtgacactttagaagtattttcctgaccagtaagcattatttctttacatgttcctccagtgttgagaaaaacctaatgcccttttttgtgttaagtttacctattaattttaatttttgtagagatagaacttagatgacggatttaaccttgaagtaggtttgtatttttaaatctatttgctttgattaccacagacagtgattgaggtagatgggcactatctggctgcttatatgaaggttttgaaaccattctgttaatccttttaacaaatggttatctgtccttttctatcttataataaaagattgaagatatgacttagtatgctcattgtactgtttgcttagagatgggaggctattttgatttttcatgctgttctaaatcatgaaagaataggtaactttgtactcatttcttaatttaaatttaagaagcacttgtagattttttgtattggtatttcagatccctattgagttttttaactgaagtcggagcaaatgaattgagcattctgagtacttggctaatcaagtgatgaagaggtagtaatatgaattctgggacctaggcatagatgacctgattctgttctcccctctactgttgaaagacagggcaggtgacttacgtaagggatatttttgtcaggtgccttctcagatattaattagaatccattttcttttactccctcatctggagtatttagcctgctttttaaaaattgtcgtaaagtatacataacataaaaattaccattttaatcatttttaactatatagttctgtggcattaagtacaaccaaactgttgtgtaattattaccactgtccacctccagaacttttcatctccccccaactgaaactttgtaatcatttaatactaactcctcctcctcctctccccccagcccctggcaaccaccattctactttctgattctgaaaatgactgctctaggtacctcatataagtggtatacaatatttgtgcttttgaaactagcttattttacttggcatgtcttaagggttcattcatgttgtagcatgggtcaaaattttcttccttttttaggctgaataatattccattatatatatgaattacgtatttgagtcatgtagatgaattatatacatgaatatatgtatctcctatttatttttaaaggcagcaaattgtattaatgattttgatatatattggcttttaagtataaagactattaccatttaactcttggaccctaaaatcgtttttcttaagcagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358160 - DNA, 4165 bp, Homo sapiens
  misc_feature (4117)..(4117): n is a, c, g, or t
ctcctgcctcagcctcccgagcagctgggattacaggtgcccacgaccatgcccagctaatttttgtatttttagtagagacagcctggccaacatggtgaagccccatctctactaaaaatacaaaaattagctgggtgtggtggctcatgcctctagtcccaggtactcaggaggccgaggacagagaattgcttaaacccaggaggcgggggttgcagagattgtgccactgcacttcagcctgggtgacaaagtgatactccatctcaaaaaaaaataaataaaagcattttaacagtattatgtttgtgctttcaatttcaattctaagttacagtttttactaagtttgagtaaatccttgagatggacatagtaggatgaattttgaggagtaatttagcaactatcaggtattttttgttaactgttatagaagaatatgtattcattatagaatataagaaaatatagataatccttagtttttatggtgctggcttgatctgaatttaaattatctcattcctcattttaagaagaggaagaagtgattgttaccaagtaactcacagctgtctgcttcacaatctagttgagattggtttttggtattttttttaagcctttggatttataatctgttatgtcaagaacttgtggcttccttaggtaaggattacttaaattggatcggagttgttttctgttttaggtagctgacttagaaacctactaactaataagtctttaaaatagagaaaaattaacactaaacaactaatccaagttttttcttaaatccaattctgatgtataaattttgaataatattaggttcttaactggaaattaccatttcagggtttgaaaaggactaggtgcgtataaaaagttcagcccctcatctgttagactgattattggtaagactctttcacttagtcagcaagctgtgcaaagcaaatactggtatgcatcctcagcaattgagatttgaaattgtaagcaaaagctattcttttgcattcctgtgtccaaatgtcatcctaaagaacttgctgacttatgccagtttgggttttagagtaagttaactgcttgttatatggcaggtgattggctgatgctgcatttctcctccccaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactggtaagatctttgcatatgatatttggaagacttagagggacagccaattgaatggacagcaagtctaggaagtctgtagtgacactttagaagtattttcctgaccagtaagcattatttctttacatgttcctccagtgttgagaaaaacctaatgcccttttttgtgttaagtttacctattaattttaatttttgtagagatagaacttagatgacggatttaaccttgaagtaggtttgtatttttaaatctatttgctttgattaccacagacagtgattgaggtagatgggcactatctggctgcttatatgaaggttttgaaaccattctgttaatccttttaacaaatggttatctgtccttttctatcttataataaaagattgaagatatgacttagtatgctcattgtactgtttgcttagagatgggaggctattttgatttttcatgctgttctaaatcatgaaagaataggtaactttgtactcatttcttaatttaaatttaagaagcacttgtagattttttgtattggtatttcagatccctattgagttttttaactgaagtcggagcaaatgaattgagcattctgagtacttggctaatcaagtgatgaagaggtagtaatatgaattctgggacctaggcatagatgacctgattctgttctcccctctactgttgaaagacagggcaggtgacttacgtaagggatatttttgtcaggtgccttctcagatattaattagaatccattttcttttactccctcatctggagtatttagcctgctttttaaaaattgtcgtaaagtatacataacataaaaattaccattttaatcatttttaactatatagttctgtggcattaagtacaaccaaactgttgtgtaattattaccactgtccacctccagaacttttcatctccccccaactgaaactttgtaatcatttaatactaactcctcctcctcctctccccccagcccctggcaaccaccattctactttctgattctgaaaatgactgctctaggtacctcatataagtggtatacaatatttgtgcttttgaaactagcttattttacttggcatgtcttaagggttcattcatgttgtagcatgggtcaaaattttcttccttttttaggctgaataatattccattatatatatgaattacgtatttgagtcatgtagatgaattatatacatgaatatatgtatctcctatttatttttaaaggcagcaaattgtattaatgattttgatatatattggcttttaagtataaagactattaccatttaactcttggaccctaaaatcgtttttcttaagcagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358161 - DNA, 2786 bp, Homo sapiens
  misc_feature (12)..(12): n is a, c, g, or t
  misc_feature (2738)..(2738): n is a, c, g, or t
tgggacgacctnggggatacaggcgcccgccacacgcccggctaatttttgtacttttagtagtgacagcctggccaacatggtgaagccccatctctactaaaaatacaaaaattagctgggtgtggtggctcatgcctctagtcccaggtactcaggaggccgaggacagagaattgcttaaacccaggaggcgggggttgcagagattgtgccactgcacttcagcctgggtgacaaagtgatactccatctcaaaaaaaaataaataaaagcattttaacagtattatgtttgtgctttcaatttcaattctaagttacagtttttactaagtttgagtaaatccttgagatggacatagtaggatgaattttgaggagtaatttagcaactatcaggtattttttgttaactgttatagaagaatatgtattcattatagaatataagaaaatatagataatccttagtttttatggtgctggcttgatctgaatttaaattatctcattcctcattttaagaagaggaagaagtgattgttaccaagtaactcacagctgtctgcttcacaatctagttgagattggtttttggtattttttttaagcctttggatttataatctgttatgtcaagaacttgtggcttccttaggtaaggattacttaaattggatcggagttgttttctgttttaggtagctgacttagaaacctactaactaataagtctttaaaatagagaaaaattaacactaaacaactaatccaagttttttcttaaatccaattctgatgtataaattttgaataatattaggttcttaactggaaattaccatttcagggtttgaaaaggactaggtgcgtataaaaagttcagcccctcatctgttagactgattattggtaagactctttcacttagtcagcaagctgtgcaaagcaaatactggtatgcatcctcagcaattgagatttgaaattgtaagcaaaagctattcttttgcattcctgtgtccaaatgtcatcctaaagaacttgctgacttatgccagtttgggttttagagtaagttaactgcttgttatatggcaggtgattggctgatgctgcatttctcctccccaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358162 - DNA, 3419 bp, Homo sapiens
  misc_feature (12)..(12): n is a, c, g, or t
  misc_feature (3371)..(3371): n is a, c, g, or t
tgggacgacctnggggatacaggcgcccgccacacgcccggctaatttttgtacttttagtagtgacagcctggccaacatggtgaagccccatctctactaaaaatacaaaaattagctgggtgtggtggctcatgcctctagtcccaggtactcaggaggccgaggacagagaattgcttaaacccaggaggcgggggttgcagagattgtgccactgcacttcagcctgggtgacaaagtgatactccatctcaaaaaaaaataaataaaagcattttaacagtattatgtttgtgctttcaatttcaattctaagttacagtttttactaagtttgagtaaatccttgagatggacatagtaggatgaattttgaggagtaatttagcaactatcaggtattttttgttaactgttatagaagaatatgtattcattatagaatataagaaaatatagataatccttagtttttatggtgctggcttgatctgaatttaaattatctcattcctcattttaagaagaggaagaagtgattgttaccaagtaactcacagctgtctgcttcacaatctagttgagattggtttttggtattttttttaagcctttggatttataatctgttatgtcaagaacttgtggcttccttaggtaaggattacttaaattggatcggagttgttttctgttttaggtagctgacttagaaacctactaactaataagtctttaaaatagagaaaaattaacactaaacaactaatccaagttttttcttaaatccaattctgatgtataaattttgaataatattaggttcttaactggaaattaccatttcagggtttgaaaaggactaggtgcgtataaaaagttcagcccctcatctgttagactgattattggtaagactctttcacttagtcagcaagctgtgcaaagcaaatactggtatgcatcctcagcaattgagatttgaaattgtaagcaaaagctattcttttgcattcctgtgtccaaatgtcatcctaaagaacttgctgacttatgccagtttgggttttagagtaagttaactgcttgttatatggcaggtgattggctgatgctgcatttctcctccccaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactggtaagatctttgcatatgatatttggaagacttagagggacagccaattgaatggacagcaagtctaggaagtctgtagtgacactttagaagtattttcctgaccagtaagcattatttctttacatgttcctccagtgttgagaaaaacctaatgcccttttttgtgttaagtttacctattaattttaatttttgtagagatagaacttagatgacggatttaaccttgaagtaggtttgtatttttaaatctatttgctttgattaccacagacagtgattgaggtagatgggcactatctggctgcttatatgaaggttttgaaaccattctgttaatccttttaacaaatggttatctgtccttttctatcttataataaaagattgaagatatgacttagtatgctcattgtactgtttgcttagagatgggaggctattttgatttttcatgctgttctaaatcatgaaagaataggtaactttgtactcatttcttaatttaaatttaagaagcacttgtagattttttgtattggtatttcagatccctattgagttttttaactgaagtcggagcaaatgaattgagcattctgagtacttggctaatcaagtgatgaagagagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358163 - DNA, 4194 bp, Homo sapiens
  misc_feature (12)..(12): n is a, c, g, or t
  misc_feature (4146)..(4146): n is a, c, g, or t
tgggacgacctnggggatacaggcgcccgccacacgcccggctaatttttgtacttttagtagtgacagcctggccaacatggtgaagccccatctctactaaaaatacaaaaattagctgggtgtggtggctcatgcctctagtcccaggtactcaggaggccgaggacagagaattgcttaaacccaggaggcgggggttgcagagattgtgccactgcacttcagcctgggtgacaaagtgatactccatctcaaaaaaaaataaataaaagcattttaacagtattatgtttgtgctttcaatttcaattctaagttacagtttttactaagtttgagtaaatccttgagatggacatagtaggatgaattttgaggagtaatttagcaactatcaggtattttttgttaactgttatagaagaatatgtattcattatagaatataagaaaatatagataatccttagtttttatggtgctggcttgatctgaatttaaattatctcattcctcattttaagaagaggaagaagtgattgttaccaagtaactcacagctgtctgcttcacaatctagttgagattggtttttggtattttttttaagcctttggatttataatctgttatgtcaagaacttgtggcttccttaggtaaggattacttaaattggatcggagttgttttctgttttaggtagctgacttagaaacctactaactaataagtctttaaaatagagaaaaattaacactaaacaactaatccaagttttttcttaaatccaattctgatgtataaattttgaataatattaggttcttaactggaaattaccatttcagggtttgaaaaggactaggtgcgtataaaaagttcagcccctcatctgttagactgattattggtaagactctttcacttagtcagcaagctgtgcaaagcaaatactggtatgcatcctcagcaattgagatttgaaattgtaagcaaaagctattcttttgcattcctgtgtccaaatgtcatcctaaagaacttgctgacttatgccagtttgggttttagagtaagttaactgcttgttatatggcaggtgattggctgatgctgcatttctcctccccaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactggtaagatctttgcatatgatatttggaagacttagagggacagccaattgaatggacagcaagtctaggaagtctgtagtgacactttagaagtattttcctgaccagtaagcattatttctttacatgttcctccagtgttgagaaaaacctaatgcccttttttgtgttaagtttacctattaattttaatttttgtagagatagaacttagatgacggatttaaccttgaagtaggtttgtatttttaaatctatttgctttgattaccacagacagtgattgaggtagatgggcactatctggctgcttatatgaaggttttgaaaccattctgttaatccttttaacaaatggttatctgtccttttctatcttataataaaagattgaagatatgacttagtatgctcattgtactgtttgcttagagatgggaggctattttgatttttcatgctgttctaaatcatgaaagaataggtaactttgtactcatttcttaatttaaatttaagaagcacttgtagattttttgtattggtatttcagatccctattgagttttttaactgaagtcggagcaaatgaattgagcattctgagtacttggctaatcaagtgatgaagaggtagtaatatgaattctgggacctaggcatagatgacctgattctgttctcccctctactgttgaaagacagggcaggtgacttacgtaagggatatttttgtcaggtgccttctcagatattaattagaatccattttcttttactccctcatctggagtatttagcctgctttttaaaaattgtcgtaaagtatacataacataaaaattaccattttaatcatttttaactatatagttctgtggcattaagtacaaccaaactgttgtgtaattattaccactgtccacctccagaacttttcatctccccccaactgaaactttgtaatcatttaatactaactcctcctcctcctctccccccagcccctggcaaccaccattctactttctgattctgaaaatgactgctctaggtacctcatataagtggtatacaatatttgtgcttttgaaactagcttattttacttggcatgtcttaagggttcattcatgttgtagcatgggtcaaaattttcttccttttttaggctgaataatattccattatatatatgaattacgtatttgagtcatgtagatgaattatatacatgaatatatgtatctcctatttatttttaaaggcagcaaattgtattaatgattttgatatatattggcttttaagtataaagactattaccatttaactcttggaccctaaaatcgtttttcttaagcagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagctaactgcttcattatgagaaactcactgttgctaataaaacagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358164 - DNA, 2066 bp, Homo sapiens
  misc_feature (2018)..(2018): n is a, c, g, or t
ctctacccttccgaaggatccagtattgaggaaaggtagaggaagaacctacaggctaagcctggcatcaggctttaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358165 - DNA, 2830 bp, Homo sapiens
  misc_feature (12)..(12): n is a, c, g, or t
  misc_feature (2782)..(2782): n is a, c, g, or t
tgggacgacctnggggatacaggcgcccgccacacgcccggctaatttttgtacttttagtagtgacagcctggccaacatggtgaagccccatctctactaaaaatacaaaaattagctgggtgtggtggctcatgcctctagtcccaggtactcaggaggccgaggacagagaattgcttaaacccaggaggcgggggttgcagagattgtgccactgcacttcagcctgggtgacaaagtgatactccatctcaaaaaaaaataaataaaagcattttaacagtattatgtttgtgctttcaatttcaattctaagttacagtttttactaagtttgagtaaatccttgagatggacatagtaggatgaattttgaggagtaatttagcaactatcaggtattttttgttaactgttatagaagaatatgtattcattatagaatataagaaaatatagataatccttagtttttatggtgctggcttgatctgaatttaaattatctcattcctcattttaagaagaggaagaagtgattgttaccaagtaactcacagctgtctgcttcacaatctagttgagattggtttttggtattttttttaagcctttggatttataatctgttatgtcaagaacttgtggcttccttaggtaaggattacttaaattggatcggagttgttttctgttttaggtagctgacttagaaacctactaactaataagtctttaaaatagagaaaaattaacactaaacaactaatccaagttttttcttaaatccaattctgatgtataaattttgaataatattaggttcttaactggaaattaccatttcagggtttgaaaaggactaggtgcgtataaaaagttcagcccctcatctgttagactgattattggtaagactctttcacttagtcagcaagctgtgcaaagcaaatactggtatgcatcctcagcaattgagatttgaaattgtaagcaaaagctattcttttgcattcctgtgtccaaatgtcatcctaaagaacttgctgacttatgccagtttgggttttagagtaagttaactgcttgttatatggcaggtgattggctgatgctgcatttctcctccccaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagctaactgcttcattatgagaaactcactgttgctaataaaacagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358166 - DNA, 4194 bp, Homo sapiens
  misc_feature (12)..(12): n is a, c, g, or t
  misc_feature (4146)..(4146): n is a, c, g, or t
tgggacgacctnggggatacaggcgcccgccacacgcccggctaatttttgtacttttagtagtgacagcctggccaacatggtgaagccccatctctactaaaaatacaaaaattagctgggtgtggtggctcatgcctctagtcccaggtactcaggaggccgaggacagagaattgcttaaacccaggaggcgggggttgcagagattgtgccactgcacttcagcctgggtgacaaagtgatactccatctcaaaaaaaaataaataaaagcattttaacagtattatgtttgtgctttcaatttcaattctaagttacagtttttactaagtttgagtaaatccttgagatggacatagtaggatgaattttgaggagtaatttagcaactatcaggtattttttgttaactgttatagaagaatatgtattcattatagaatataagaaaatatagataatccttagtttttatggtgctggcttgatctgaatttaaattatctcattcctcattttaagaagaggaagaagtgattgttaccaagtaactcacagctgtctgcttcacaatctagttgagattggtttttggtattttttttaagcctttggatttataatctgttatgtcaagaacttgtggcttccttaggtaaggattacttaaattggatcggagttgttttctgttttaggtagctgacttagaaacctactaactaataagtctttaaaatagagaaaaattaacactaaacaactaatccaagttttttcttaaatccaattctgatgtataaattttgaataatattaggttcttaactggaaattaccatttcagggtttgaaaaggactaggtgcgtataaaaagttcagcccctcatctgttagactgattattggtaagactctttcacttagtcagcaagctgtgcaaagcaaatactggtatgcatcctcagcaattgagatttgaaattgtaagcaaaagctattcttttgcattcctgtgtccaaatgtcatcctaaagaacttgctgacttatgccagtttgggttttagagtaagttaactgcttgttatatggcaggtgattggctgatgctgcatttctcctccccaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactggtaagatctttgcatatgatatttggaagacttagagggacagccaattgaatggacagcaagtctaggaagtctgtagtgacactttagaagtattttcctgaccagtaagcattatttctttacatgttcctccagtgttgagaaaaacctaatgcccttttttgtgttaagtttacctattaattttaatttttgtagagatagaacttagatgacggatttaaccttgaagtaggtttgtatttttaaatctatttgctttgattaccacagacagtgattgaggtagatgggcactatctggctgcttatatgaaggttttgaaaccattctgttaatccttttaacaaatggttatctgtccttttctatcttataataaaagattgaagatatgacttagtatgctcattgtactgtttgcttagagatgggaggctattttgatttttcatgctgttctaaatcatgaaagaataggtaactttgtactcatttcttaatttaaatttaagaagcacttgtagattttttgtattggtatttcagatccctattgagttttttaactgaagtcggagcaaatgaattgagcattctgagtacttggctaatcaagtgatgaagaggtagtaatatgaattctgggacctaggcatagatgacctgattctgttctcccctctactgttgaaagacagggcaggtgacttacgtaagggatatttttgtcaggtgccttctcagatattaattagaatccattttcttttactccctcatctggagtatttagcctgctttttaaaaattgtcgtaaagtatacataacataaaaattaccattttaatcatttttaactatatagttctgtggcattaagtacaaccaaactgttgtgtaattattaccactgtccacctccagaacttttcatctccccccaactgaaactttgtaatcatttaatactaactcctcctcctcctctccccccagcccctggcaaccaccattctactttctgattctgaaaatgactgctctaggtacctcatataagtggtatacaatatttgtgcttttgaaactagcttattttacttggcatgtcttaagggttcattcatgttgtagcatgggtcaaaattttcttccttttttaggctgaataatattccattatatatatgaattacgtatttgagtcatgtagatgaattatatacatgaatatatgtatctcctatttatttttaaaggcagcaaattgtattaatgattttgatatatattggcttttaagtataaagactattaccatttaactcttggaccctaaaatcgtttttcttaagcagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaaggtgtttggaaacatctgagcctctttggttgctggggaaggccaggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358167 - DNA, 1814 bp, Homo sapiens
  misc_feature (1766)..(1766): n is a, c, g, or t
ctctacccttccgaaggatccagtattgaggaaaggtagaggaagaacctacaggctaagcctggcatcaggctttaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358168 - DNA, 1210 bp, Homo sapiens
  misc_feature (1162)..(1162): n is a, c, g, or t
atactaatttatatttattttaataccaagaacgaaaacgcaaccgaaaaagatcttcgaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358169 - DNA, 2250 bp, Homo sapiens
  misc_feature (12)..(12): n is a, c, g, or t
  misc_feature (2202)..(2202): n is a, c, g, or t
tgggacgacctnggggatacaggcgcccgccacacgcccggctaatttttgtacttttagtagtgacagcctggccaacatggtgaagccccatctctactaaaaatacaaaaattagctgggtgtggtggctcatgcctctagtcccaggtactcaggaggccgaggacagagaattgcttaaacccaggaggcgggggttgcagagattgtgccactgcacttcagcctgggtgacaaagtgatactccatctcaaaaaaaaataaataaaagcattttaacagtattatgtttgtgctttcaatttcaattctaagttacagtttttactaagtttgagtaaatccttgagatggacatagtaggatgaattttgaggagtaatttagcaactatcaggtattttttgttaactgttatagaagaatatgtattcattatagaatataagaaaatatagataatccttagtttttatggtgctggcttgatctgaatttaaattatctcattcctcattttaagaagaggaagaagtgattgttaccaagtaactcacagctgtctgcttcacaatctagttgagattggtttttggtattttttttaagcctttggatttataatctgttatgtcaagaacttgtggcttccttaggtaaggattacttaaattggatcggagttgttttctgttttaggtagctgacttagaaacctactaactaataagtctttaaaatagagaaaaattaacactaaacaactaatccaagttttttcttaaatccaattctgatgtataaattttgaataatattaggttcttaactggaaattaccatttcagggtttgaaaaggactaggtgcgtataaaaagttcagcccctcatctgttagactgattattggtaagactctttcacttagtcagcaagctgtgcaaagcaaatactggtatgcatcctcagcaattgagatttgaaattgtaagcaaaagctattcttttgcattcctgtgtccaaatgtcatcctaaagaacttgctgacttatgccagtttgggttttagagtaagttaactgcttgttatatggcaggtgattggctgatgctgcatttctcctccccaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358170 - DNA, 455 bp, Homo sapiens
ttcatgttgtagcatgggtcaaaattttcttccttttttaggctgaataatattccattatatatatgaattacgtatttgagtcatgtagatgaattatatacatgaatatatgtatctcctatttatttttaaaggcagcaaattgtattaatgattttgatatatattggcttttaagtataaagactattaccatttaactcttggaccctaaaatcgtttttcttaagcagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggtatgccctgaataaaattgaattatactgaattat

SEQ ID NO: 358171 - DNA, 383 bp, Homo sapiens
attttttatcaatttcttaaaaaaaaattcccaaaccccaacacagttggtattggtcttcccagtttggtgtataaatagagcaaggttgagaaaagtctgtgtttttgctttatgatgtccttttatactgagatgagggacagaggaccatgccacatttaaaaatttctctcattacctagcattgtatcttttacatagtattctccaagtgctttgttgtttttcaggtattaacagatctgattggtcaggttaattaacaggtgaagcaagtaatgccactgttgcccttgctttgtttttcttagtgtttggaaacatctgagcctctttggttgctggggaaggccaggtaaagaactaaggggactaatctt

SEQ ID NO: 358172 - DNA, 3430 bp, Homo sapiens
  misc_feature (3382)..(3382): n is a, c, g, or t
ctctacccttccgaaggatccagtattgaggaaaggtagaggaagaacctacaggctaagcctggcatcaggctttaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactggtaagatctttgcatatgatatttggaagacttagagggacagccaattgaatggacagcaagtctaggaagtctgtagtgacactttagaagtattttcctgaccagtaagcattatttctttacatgttcctccagtgttgagaaaaacctaatgcccttttttgtgttaagtttacctattaattttaatttttgtagagatagaacttagatgacggatttaaccttgaagtaggtttgtatttttaaatctatttgctttgattaccacagacagtgattgaggtagatgggcactatctggctgcttatatgaaggttttgaaaccattctgttaatccttttaacaaatggttatctgtccttttctatcttataataaaagattgaagatatgacttagtatgctcattgtactgtttgcttagagatgggaggctattttgatttttcatgctgttctaaatcatgaaagaataggtaactttgtactcatttcttaatttaaatttaagaagcacttgtagattttttgtattggtatttcagatccctattgagttttttaactgaagtcggagcaaatgaattgagcattctgagtacttggctaatcaagtgatgaagaggtagtaatatgaattctgggacctaggcatagatgacctgattctgttctcccctctactgttgaaagacagggcaggtgacttacgtaagggatatttttgtcaggtgccttctcagatattaattagaatccattttcttttactccctcatctggagtatttagcctgctttttaaaaattgtcgtaaagtatacataacataaaaattaccattttaatcatttttaactatatagttctgtggcattaagtacaaccaaactgttgtgtaattattaccactgtccacctccagaacttttcatctccccccaactgaaactttgtaatcatttaatactaactcctcctcctcctctccccccagcccctggcaaccaccattctactttctgattctgaaaatgactgctctaggtacctcatataagtggtatacaatatttgtgcttttgaaactagcttattttacttggcatgtcttaagggttcattcatgttgtagcatgggtcaaaattttcttccttttttaggctgaataatattccattatatatatgaattacgtatttgagtcatgtagatgaattatatacatgaatatatgtatctcctatttatttttaaaggcagcaaattgtattaatgattttgatatatattggcttttaagtataaagactattaccatttaactcttggaccctaaaatcgtttttcttaagcagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358173 - DNA, 1961 bp, Homo sapiens
  misc_feature (1913)..(1913): n is a, c, g, or t
ctctacccttccgaaggatccagtattgaggaaaggtagaggaagaacctacaggctaagcctggcatcaggctttaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358174 - DNA, 1857 bp, Homo sapiens
  misc_feature (1809)..(1809): n is a, c, g, or t
ctctacccttccgaaggatccagtattgaggaaaggtagaggaagaacctacaggctaagcctggcatcaggctttaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358175 - DNA, 1249 bp, Homo sapiens
  misc_feature (1201)..(1201): n is a, c, g, or t
tacacgttaaaacatcatccacaccactcacaccgaaacaaaacaaaaacctcagggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagctaactgcttcattatgagaaactcactgttgctaataaaacagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagtggcctcgttggcctcagcggtggagntctcggccgctctctttcaccatgacataaattttatgcctttcttac

SEQ ID NO: 358176 - DNA, 391 bp, Homo sapiens
agtgtttgtttttaggtaagagtacattggtgttttacacgtaccctttgggttcattgcatgtttattccttggctcttctgaactgcttgcttcctttcgcctctttttagaacgtttaacttttggcctcctcttatgtttcctccttctgcttctctcatgttcaagttcactttctgaagatgattctgaagaagaggaggaattggaagaggaatccgagccttctgaatgagttggtttcttcctttttttctcaaaaacttttaagaaacattaataaaaacattagtactaaattcagtgcctacctttcagagtaaaaaatgtgattactgaatatcataaaatatgctttacatacagcaaacaaaaaatgaaatgtaga

SEQ ID NO: 358177 - DNA, 553 bp, Homo sapiens
ctccacccccagccccagctccagcccccagcccgtccccactgctcatatccgagcagatagaccccggccccaccctcccgtgctgagcctcctttctgccgggaagttcgtccgggagtcaaacatcgctgccctccggttgcgccacggagggggagccaggataggaagctgccgtgaaatcaggaagctgagcgcgccgggccccggatccgaacagaaaaggcttccacccgctcccctgagggatcccacgctgagggactgaaccccgcaccccagccgcgctcaccacccccaccctctcgcctgggctgctctgacctggggttcactttctgaagatgattctgaagaagaggaggaattggaagaggaatccgagccttctgaatgagttggtttcttcctttttttctcaaaaacttttaagaaacattaataaaaacattagtactaaattcagtgcctacctttcagagtaaaaaatgtgattactgaatatcataaaatatgctttacatacagcaaacaaaaaatgaaatgtaga

SEQ ID NO: 358178 - DNA, 655 bp, Homo sapiens
ctccacccccagccccagctccagcccccagcccgtccccactgctcatatccgagcagatagaccccggccccaccctcccgtgctgagcctcctttctgccgggaagttcgtccgggagtcaaacatcgctgccctccggttgcgccacggagggggagccaggataggaagctgccgtgaaatcaggaagctgagcgcgccgggccccggatccgaacagaaaaggcttccacccgctcccctgagggatcccacgctgagggactgaaccccgcaccccagccgcgctcaccacccccaccctctcgcctgggctgctctgacctgggggtggtctatatgctcttaatctctgcatttcctctttccagtgaggaggagtttcactgctgtcatcatcatctgactcagaacaggatcttgatcttggagttcactttctgaagatgattctgaagaagaggaggaattggaagaggaatccgagccttctgaatgagttggtttcttcctttttttctcaaaaacttttaagaaacattaataaaaacattagtactaaattcagtgcctacctttcagagtaaaaaatgtgattactgaatatcataaaatatgctttacatacagcaaacaaaaaatgaaatgtaga

SEQ ID NO: 358179 - DNA, 685 bp, Homo sapiens
tttctggtgcccagcgtggggcaatggagacatcacactccctctgaagcctgcagaaaagatcctgagacaaccgacaaaaagccaacagaagatttcaagaggatattatgcttttctggaccataattatatgattattactgctagctgtagagctttaagtcaagcataataaaaacaagaattaaagagcaaggagactttttggtgaaaggaaagtatcttcaggaggcaggtaaaaggtgcaatgaagactgaagaatgggagaatggatactgttatcagcagagaccagaaggctatataccaggcagtggctgttacacagaaatatccttcccaatggtctgagaggcccggtttgagaagaatgaaaactgattgcagacaaccacggaagcaagaagcaccagaatgcactccctttcttagaattcctgcaaactgaagggtcattgggttacccacttcctcttttgggactaaactatttcctaatctcttatcactagggaatagttcttcccaaaccaggtcacccaaatacagtggtgtgtaagaggtggctgcttaaaaacgcctatagcaatggggaagcggtaagagaggtaaaaagagaacagactcattaagtacaaaaaaattcaaataaaagagtaataaaagcaaatttgttccaac

SEQ ID NO: 358180 - DNA, 1621 bp, Homo sapiens
atagtatactctatattttcatagtaatacacattgatctgtatgcaagagtttgaatttgaaagctctttaaatctacaaaatgtgttcagtatatcttgttttattaatggcaccttcgtgagaaaaacaataagcactttcaagggtaccaaattttaccctgagcatcggatacttcctttagaatctgaaacattaacttcatattaaagtatactgtgggaaattgagtttgatatgatatataatctataaatcaacctaatgttgctataaaacgaattgcaattttttttagagataatcacgttatggaaaggattcgtttaacactcacaaagaaaatataaattgttactatgtttaagttcaataatatacaaatgaaacagatataccatatgttcctaattatttcagtaatccagaaaacataaaaacaaaatgaaatgaaagaaaaggaatacaaccttctctttcagtcttgtttgagtaactgctttcctggtgttatctctactgaagcttgtttggcctttttagatttccttcttcacaatcagatttctgcaagatcattcttcagcaagatttggcactatctttaaacaagcattacttttcttacagatttcaagaggatattatgcttttctggaccataattatatgattattactgctagctgtagagctttaagtcaagcataataaaaacaagaattaaagagcaaggagactttttggtgaaaggtgagtgttgcaacaggtgacccatttggtagaacaacaaaagaacccatgacatcttaatttttctccaccagtggaattgctctgactcagttaaaacgtgtttgggaaaaaagtacatacacacgggaaatttcagattcaactactaattcagactgccctcatccaatagaacaataagcaaagaaaatcatcaaaacctcagaaagcaccatcataacagaaattatcctgtttctttccagacttgtgaaataaattctaaacacagcagtcaaattaaatgtgaaatgttttattcttttcttttttttaagagattgggtcatgctttgttgctcaggctggagtacagtggcatgatcgtagctcactgcagccttgaactcctgggctcaagcaatcctcccgcctcagccttctgagttgctgggattacaggtgtgcgcctccatgtccagctattctttacaaggtctcagtatcatttttctctctttgcccatggcaagaccagcaacttaccatcaatataggtatatatgaaacttgataaaacttttcaaaaaactcaacattaagggctctaatcagaaattctcatcaatttgaacctattccagaggttgaggggagagaagtcatactgaactatataccagtgttaagccaatgttacttttaattattttttgttatcctgaaaaatgaataatatgttgccatgtgcaggtcttgccaattctgctaagtctgttcatgtgaaatggatgctgtgatatcctcagaaagtttgtcttaggtatgttaaacatggtccctgccatcttttctactgtgtattcctatcactggcataccc

SEQ ID NO: 358181 - DNA, 1567 bp, Homo sapiens
atagtatactctatattttcatagtaatacacattgatctgtatgcaagagtttgaatttgaaagctctttaaatctacaaaatgtgttcagtatatcttgttttattaatggcaccttcgtgagaaaaacaataagcactttcaagggtaccaaattttaccctgagcatcggatacttcctttagaatctgaaacattaacttcatattaaagtatactgtgggaaattgagtttgatatgatatataatctataaatcaacctaatgttgctataaaacgaattgcaattttttttagagataatcacgttatggaaaggattcgtttaacactcacaaagaaaatataaattgttactatgtttaagttcaataatatacaaatgaaacagatataccatatgttcctaattatttcagtaatccagaaaacataaaaacaaaatgaaatgaaagaaaaggaatacaaccttctctttcagtcttgtttgagtaactgctttcctggtgttatctctactgaagcttgtttggcctttttagatttccttcttcacaatcagatttctgcaagatcattcttcagcaagatttggcactatctttaaacaagcattacttttcttacagatttcaagaggatattatgcttttctggaccataattatatgattattactgctagctgtagagctttaagtcaagcataataaaaacaagaattaaagagcaaggagactttttggtgaaaggtgagtgttgcaacaggtgacccatttggtagaacaacaaaagaacccatgacatcttaatttttctccaccagtggaattgctctgactcagttaaaacgtgtttgggaaaaaagtacatacacacgggaaatttcagattcaactactaattcagactgccctcatccaatagaacaataagcaaagaaaatcatcaaaacctcagaaagcaccatcataacagaaattatcctgtttctttccagacttttcttttttttaagagattgggtcatgctttgttgctcaggctggagtacagtggcatgatcgtagctcactgcagccttgaactcctgggctcaagcaatcctcccgcctcagccttctgagttgctgggattacaggtgtgcgcctccatgtccagctattctttacaaggtctcagtatcatttttctctctttgcccatggcaagaccagcaacttaccatcaatataggtatatatgaaacttgataaaacttttcaaaaaactcaacattaagggctctaatcagaaattctcatcaatttgaacctattccagaggttgaggggagagaagtcatactgaactatataccagtgttaagccaatgttacttttaattattttttgttatcctgaaaaatgaataatatgttgccatgtgcaggtcttgccaattctgctaagtctgttcatgtgaaatggatgctgtgatatcctcagaaagtttgtcttaggtatgttaaacatggtccctgccatcttttctactgtgtattcctatcactggcataccc

SEQ ID NO: 358182 - DNA, 1293 bp, Homo sapiens
tgaatctacatgatagagtggaagccacaaaggaagaagaagaagagattctatctgggtatggagaatgaaaaaaaaaaaaggtgtaaagaggggtctggctctgtcatccaggctggagtgcagtgactcaatcatggctcactgcagccttaacttccggacctcaggtgattctcccacctcagcctgtcaagtagctgggactacagagacggggtctcgctatgttgcctaggctcgtcttgaactcctggcctcaaacaatgctccagcctcgacctctcaaagcgttggtattacagatttcaagaggatattatgcttttctggaccataattatatgattattactgctagctgtagagctttaagtcaagcataataaaaacaagaattaaagagcaaggagactttttggtgaaaggtgagtgttgcaacaggtgacccatttggtagaacaacaaaagaacccatgacatcttaatttttctccaccagtggaattgctctgactcagttaaaacgtgtttgggaaaaaagtacatacacacgggaaatttcagattcaactactaattcagactgccctcatccaatagaacaataagcaaagaaaatcatcaaaacctcagaaagcaccatcataacagaaattatcctgtttctttccagacttgtgaaataaattctaaacacagcagtcaaattaaatgtgaaatgttttattcttttcttttttttaagagattgggtcatgctttgttgctcaggctggagtacagtggcatgatcgtagctcactgcagccttgaactcctgggctcaagcaatcctcccgcctcagccttctgagttgctgggattacaggtgtgcgcctccatgtccagctattctttacaaggtctcagtatcatttttctctctttgcccatggcaagaccagcaacttaccatcaatataggtatatatgaaacttgataaaacttttcaaaaaactcaacattaagggctctaatcagaaattctcatcaatttgaacctattccagaggttgaggggagagaagtcatactgaactatataccagtgttaagccaatgttacttttaattattttttgttatcctgaaaaatgaataatatgttgccatgtgcaggtcttgccaattctgctaagtctgttcatgtgaaatggatgctgtgatatcctcagaaagtttgtcttaggtatgttaaacatggtccctgccatcttttctactgtgtattcctatcactggcataccc

SEQ ID NO: 358183 - DNA, 1568 bp, Homo sapiens
atagtatactctatattttcatagtaatacacattgatctgtatgcaagagtttgaatttgaaagctctttaaatctacaaaatgtgttcagtatatcttgttttattaatggcaccttcgtgagaaaaacaataagcactttcaagggtaccaaattttaccctgagcatcggatacttcctttagaatctgaaacattaacttcatattaaagtatactgtgggaaattgagtttgatatgatatataatctataaatcaacctaatgttgctataaaacgaattgcaattttttttagagataatcacgttatggaaaggattcgtttaacactcacaaagaaaatataaattgttactatgtttaagttcaataatatacaaatgaaacagatataccatatgttcctaattatttcagtaatccagaaaacataaaaacaaaatgaaatgaaagaaaaggaatacaaccttctctttcagtcttgtttgagtaactgctttcctggtgttatctctactgaagcttgtttggcctttttagatttccttcttcacaatcagatttctgcaagatcattcttcagcaagatttggcactatctttaaacaagcattacttttcttacagatttcaagaggatattatgcttttctggaccataattatatgattattactgctagctgtagagctttaagtcaagcataataaaaacaagaattaaagagcaaggagactttttggtgaaaggtgagtgttgcaacaggtgacccatttggtagaacaacaaaagaacccatgacatcttaatttttctccaccagtggaattgctctgactcagttaaaacgtgtttgggaaaaaagtacatacacacgggaaatttcagattcaactactaattcagactgccctcatccaatagaacaataagcaaagaaaatcatcaaaacctcagaaagcaccatcataacagaaattatcctgtttctttccagacttgtgaaataaattctaaacacagcagtcaaattaaatgtgaaatgttttattcttttcttttttttaagagattgggtcatgctttgttgctcaggctggagtacagtggcatgatcgtagctcactgcagccttgaactcctgggctcaagcaatcctcccgcctcagccttctgagttgctgggattacaggtgtgcgcctccatgtccagctattctttacaaggtctcagtatcatttttctctctttgcccatggcaagaccagcaacttaccatcaatataggtatatatgaaacttgataaaacttttcaaaaaactcaacattaagggctctaatcagaaattctcatcaatttgaacctattccagaggttgaggggagagaagtcatactgaactatataccagtgttaagccaatgttacttttaattattttttgttatcctgttcatgtgaaatggatgctgtgatatcctcagaaagtttgtcttaggtatgttaaacatggtccctgccatcttttctactgtgtattcctatcactggcataccc

SEQ ID NO: 358184 - DNA, 1224 bp, Homo sapiens
atagtatactctatattttcatagtaatacacattgatctgtatgcaagagtttgaatttgaaagctctttaaatctacaaaatgtgttcagtatatcttgttttattaatggcaccttcgtgagaaaaacaataagcactttcaagggtaccaaattttaccctgagcatcggatacttcctttagaatctgaaacattaacttcatattaaagtatactgtgggaaattgagtttgatatgatatataatctataaatcaacctaatgttgctataaaacgaattgcaattttttttagagataatcacgttatggaaaggattcgtttaacactcacaaagaaaatataaattgttactatgtttaagttcaataatatacaaatgaaacagatataccatatgttcctaattatttcagtaatccagaaaacataaaaacaaaatgaaatgaaagaaaaggaatacaaccttctctttcagtcttgtttgagtaactgctttcctggtgttatctctactgaagcttgtttggcctttttagatttccttcttcacaatcagatttctgcaagatcattcttcagcaagatttggcactatctttaaacaagcattacttttcttacagatttcaagaggatattatgcttttctggaccataattatatgattattactgctagctgtagagctttaagtcaagcataataaaaacaagaattaaagagcaaggagactttttggtgaaaggaaagtatcttcaggaggcaggtaaaaggtgcaatgaagactgaagaatgggagaatggatactgttatcagcagagaccagaaggctatataccaggcagtggctgttacacagaaatatccttcccaatggtctgagaggcccggtttgagaagaatgaaaactgattgcagacaaccacggaagcaagaagcaccagaatgcactccctttcttagaattcctgcaaactgaagggtcattgggttacccacttcctcttttgggactaaactatttcctaatctcttatcactagggaatagttcttcccaaaccaggtcacccaaatacagtggtgtgtaagaggtggctgcttaaaaacgcctatagcaatggggaagcggtaagagaggtaaaaagagaacagactcattaagtacaaaaaaattcaaataaaagagtaataaaagcaaatttgttccaac

SEQ ID NO: 358185 - DNA, 413 bp, Homo sapiens
cctgctgcaaccattataacaaatgctgtctttttcaagatcaccaacaaacttctggttgtcaaatcacttttatatcctaattttgcttcagctctcagtgtcatgcaacacagttgacttcttccacttttcttttgggctttctgctattctcttacctttctgggtattattcttttgctggctctttctctttgctcaaattctaaattctggcattccctaggactcaggactttagtctcttctttctttagatgattacatccatttccccggctttaagtgtaactcatatactgaaagacttatatttttatctctagctgaaacctattctgtgtgctaggctcataaaattctttttttttttttttgcttttgagacggagtctcgctctgtcacccag

SEQ ID NO: 358186 - DNA, 193 bp, Homo sapiens
gacctcaagtgatctgctcgcttcagcctcccaaagtgttgggattccaggtgtgggccaccgcactcaggccaggcgatttcttgaatacagctttcagaatgtatttattgcaaggactgatactgtaggtggatgacaaggtcaggagatcgagaccatcctggctaacacggtgaaaccccgtctctac

SEQ ID NO: 358187 - DNA, 895 bp, Homo sapiens
ttctttcttttccaagaactttgtcctaaaacagagttctgctgaatttcaccctgaaaatgtaaattaacagcttatctgcacaggtatgggacaaagacaggactagaagtcttccctccgctcacgggagtacaaacgcatctttgactccctcctctactgttcttccataaagatgcaggttcactgagcacaggatgaatgcacagtttactgttcctcttccacctttcccatgtaaaacggggattcagggaaggctcatcaacgcctcaaaagaatgcaaccgctggcctcttttatccaccctcccgtttttttctttccatttttccctactgtctgctctttcctctttgaatacggaagttctcaaaccctctttggaaatcgtgcaggccgcaggtcctactgtgctccttcggacccgcctagcccgcggagcccatccttctcctgaagttgcggatctggtttgccgacactttcccctgggcacgtcctcaacccaggcaaaataaacctctcgatagattgagactcctcagtcattttctttggtgtacaaagcacgggctcgtcttcctgtgtccatcccggggtttcggggcagcagagctccgtctccacaagtgttcaggatctattcagatggttcagcctcagggccaggctgggtcctctgcaccccaagctgtgtcctctgtctatggcaatgacccagatagggccggttctcagatggctctgaagaaatgtttaggggtgtctggggactgtgcaatacctttctccacactcagattacagagttctcccttgaccgtggaccacttcctggacacggctgcacacagctgtcacctccctaagctgagccttaaagaccaag

SEQ ID NO: 358188 - DNA, 508 bp, Homo sapiens
atgttgctttctatatgtgtgatgctcttgcacctttccttgctccttcttcaaatgccctcaggactgaaatgggctgaattctggcccgtcttcttctatgaagcttatttctagacacagggcctctctcagcctccttcctcttctgagttccaatcctgtatggtgcacgagaatcacagagatagaatggcattatgcctgttagaaaaaggagtcactagggaaagagcagcctgcctgggttgcagagccagggggatgagctggatcatactccggcttcctcacgcctgccctttccacgaccccacagtgggactgtcaccccacctgcatgtgcgttccttgagagcaggaagaggctggacacttcacgaacatctaatgctctgtgagattcacaagactacgcacagactcctctttttaaaggctatttctttttcagtgaaccataaataagatatttcagaggctcttaccccagaaaatatatgtaaat

SEQ ID NO: 358189 - DNA, 355 bp, Homo sapiens
tggcatactctaaaatttatatcttatgtgcacagtagaaagtaggttacataaaataagttcattcactactttaaccctaaagtattttgtccaccagtgagggtttattgtaagtcatccctcctctccgtaacagaatataaacatcggtggcaaggactttctctcttcatagctatgttcctagatcctagaagaggtacttaataatttaccttgtttttggttctcactccaaatattctaagtaaactacactgacacggcaatctaaaagtgtcagaggatgggtgcagtggctcacacctgtaatcctggcactttgggaggctgagacaagaggatcacttga

SEQ ID NO: 358190 - DNA, 3469 bp, Homo sapiens
  misc_feature (1)..(2): n is a, c, g, or t
  misc_feature (7)..(7): n is a, c, g, or t
  misc_feature (10)..(10): n is a, c, g, or t
nncacgngtncggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgcattatggatgatgccatcaacatcctgcagaatgaaacatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagagtcgaggtttcaccatggtggccaggctggtctcaaactcctgagctcaagtgatcctcccgcctcggcctcccaaagtgctggaattacaggcgtgagccactgtgcccggcctaggctcattctttcttctgtcttcatcttctgcatcaagcagcctctgcttaacaattcagatctaactgtgccccctgtattccatcctgtggggaaaaggaaacaggaagagaaaggcatctccttcttgatgtcaaagtccccaggaggcatcgttaactatcgtaacgttacctgccgagcatgagatgggaggaagtgtcatagtccagtggacggttttttccaggctactgtgaaacctgatgtgttatgccggccctgaaacagacagcttcccaagtgactcagaccttaagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacaccaa

SEQ ID NO: 358191 - DNA, 1694 bp, Homo sapiens
  misc_feature (1)..(2): n is a, c, g, or t
  misc_feature (7)..(7): n is a, c, g, or t
  misc_feature (10)..(10): n is a, c, g, or t
  misc_feature (1694)..(1694): n is a, c, g, or t
nncacgngtncggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaagagatggagtctctctgtgttgcccaggctggtcgcgaattcctgagctcaagcaaccctcctgcttggccctcccaaaggattgggattacagacgagaatgatccatctgtgagactgaaaattgcatcattgttgggtttattatcaaagacagcaggattttcaccagactgcattatggatgatgccatcaacatcctgcagaatgaaaagtctcatcaagtcctagctcaactgctggatactttgcttgcaattggcactaagctaccagagaatcaagctatccaaatgcgattagttgatgtggcctgcaaggtaagagtataaaatctattcagatccatcctaaactggtaactgaggactgctaaggaccattaatggttttaggagctgccttatttttttcatctcttggtgttggattaggaataaagttaagtacacttgttataaagtgtatttcgtcatcctttcaaaacaaatgaaaataattacagtacatagttactgtgtatattgtgcctaataatgcactctgcttgttatggtgctttgtattcagtttttcatttggtcctcacaatccttcaagtaagtaccgttatttctcttttacaaaggtgaaaattaagatttatggagtctgatttgtctaagtttgcacagctaggaggttgcagtaccagggtataaactgtattttttctgaccccaaacttgttttgtttttattatgccttgttgcttcaataaacagaccaactatacacaagtaaatgtatgggaaaagttttgtacgttctttttttctgatttttaaatacatgtattaatacattaattgtgccttttgatttaatttggaggttaattagcctctttgtgtatacacagcaacccctagaaccctgtagaattgattttactttggatctttttgataactttgagaatataaaaaagtcaaatgcatttgaattgtgttagagtattatattcttgaaattagaaagctatctcagagatgcaggaaagattacttgatttatcttaaaacaacaggcatacataaaaccaaaaacactttgacaagtacaatactaaaagcttaaatagggccaggtgcggtggctcacacctataatcccagcactttgggaggcagaggtgggcggatcatttgacatcaggagtttgaaaccagcctgaccaacatggtgaaaccccatctctactaaaaatacaaaaaaaattagccgggcacggtgatgcctgcctgtaatcccagctactagggaggctgaggcaggagaatcgcttgaacctgcaagacggaggttatgtgagtggagattgagccactgcactccagtctgggtgatagagtgagactctgtctttn

SEQ ID NO: 358192 - DNA, 940 bp, Homo sapiens
  misc_feature (1)..(2): n is a, c, g, or t
  misc_feature (7)..(7): n is a, c, g, or t
  misc_feature (10)..(10): n is a, c, g, or t
  misc_feature (748)..(748): n is a, c, g, or t
  misc_feature (752)..(752): n is a, c, g, or t
  misc_feature (754)..(754): n is a, c, g, or t
  misc_feature (761)..(761): n is a, c, g, or t
nncacgngtncggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaagagatggagtctctctgtgttgcccaggctggtcgcgaattcctgagctcaagcaaccctcctgcttggccctcccaaaggattgggattacagacgtgagctaccacatctgaccaaaatcaggatttctgttctcaagaagttttcgatctctcagtgatctattttccgttagtctttttcttagcaatatctaccattattattatattaaagatctattaccaataatcatctataataatacttcttagagcagttaacattatattgcttgttagagtttgaaagcactttccatatgtaatattttatttaatcctggtgacagcaccattgttatctctaaattccagatatggaactaagcttagagctgtttagtatccaaggtcacccagctagtaaatggaaggtatggatttgaacttgggttttttttttaaaaaaccttttgtttgggncttngnatttctntgtcctccgcgaagttttatccggtccctctggtccattctttggggcgccggttttctcttccccattttttccccttccatttggaagcgcgcttttctggttttcaaaaaaggggggcgtcactggggggggtgcttgtgtcgtcgcctcttgtctcgctttccggggggggggtg

SEQ ID NO: 358193 - DNA, 695 bp, Homo sapiens
taagataatatctcaagacagaaaggaagggtcattccctttcatgcattgctcttttgatttgcaaaaacatccctgagaagctccccagccagcatactctcgtgctccattgtctagaactggcttacttgcccaccagcaaaccagtcactggaaaatgggaatgggattgccatgatgggtttagaccaatagtggttcagctcttgggctggacctgccttttccgagcactttgctgcctgcctgatacctgagtaaaatcagggctctctcaggaagaaagatgggggaaatggctcttggttaaataaccagttcttttatctttataataaccagtttttttagatgaattaaccgagttccagaataactgggtgacttatctgaagtcatagagttagcaaaagtatatggttgagaatttccaattccagttcaggttttctgattccagttcctagtacttttcaaaggactaactttactaatttgttgatgtgcattcttatttgtttgtttcaggtgcttgaagtttctgggaagtcggcatccaaccctggtgcttcccttggtgccagagcttctgagcacccacccattttttgacacagctgaaccagacatggatgatccagcttgtatcctctgtgcttaggatgggccctgatgtgttggcaggacagctt

SEQ ID NO: 358194 - DNA, 3159 bp, Homo sapiens
  misc_feature (1)..(2): n is a, c, g, or t
  misc_feature (7)..(7): n is a, c, g, or t
  misc_feature (10)..(10): n is a, c, g, or t
nncacgngtncggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgcattatggatgatgccatcaacatcctgcagaatgaaaagtctcatcaagtcctagctcaactgctggatactttgcttgcaattggcactaagctaccagagaatcaagctatccaaatgcgattagttgatgtggcctgcaagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacaccaa

SEQ ID NO: 358195 - DNA, 3092 bp, Homo sapiens
  misc_feature (1)..(2): n is a, c, g, or t
  misc_feature (7)..(7): n is a, c, g, or t
  misc_feature (10)..(10): n is a, c, g, or t
nncacgngtncggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgcattatggatgatgccatcaacatcctgcagaatgaaaagtctcatcaagtcctagctcaactgctggatactttgcttgcaattggcactaagctaccagagaatcaagctatccaaatgcgattagttgatgtggcctgcaagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcatt

SEQ ID NO: 358196 - DNA, 3203 bp, Homo sapiens
  misc_feature (1)..(2): n is a, c, g, or t
  misc_feature (7)..(7): n is a, c, g, or t
  misc_feature (10)..(10): n is a, c, g, or t
nncacgngtncggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgcattatggatgatgccatcaacatcctgcagaatgaaaagtctcatcaagtcctagctcaactgctggatactttgcttgcaattggcactaagctaccagagaatcaagctatccaaatgcgattagttgatgtggcctgcaagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtaatgacttttttgcccatttactcactgagtcccataatgtggtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacaccaa

SEQ ID NO: 358197 - DNA, 3254 bp, Homo sapiens
  misc_feature (1)..(2): n is a, c, g, or t
  misc_feature (7)..(7): n is a, c, g, or t
  misc_feature (10)..(10): n is a, c, g, or t
nncacgngtncggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaagagatggagtctctctgtgttgcccaggctggtcgcgaattcctgagctcaagcaaccctcctgcttggccctcccaaaggattgggattacagacgagaatgatccatctgtgagactgaaaattgcatcattgttgggtttattatcaaagacagcaggattttcaccagactgcattatggatgatgccatcaacatcctgcagaatgaaaagtctcatcaagtcctagctcaactgctggatactttgcttgcaattggcactaagctaccagagaatcaagctatccaaatgcgattagttgatgtggcctgcaagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacaccaa

SEQ ID NO: 358198 - DNA, 2037 bp, Homo sapiens
ggatccagtccacagagtaatacgggctgtgactgatgatcggagcttgtgagtatgtcatgggtgaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacaccaa

SEQ ID NO: 358199 - DNA, 3283 bp, Homo sapiens
  misc_feature (1)..(2): n is a, c, g, or t
  misc_feature (7)..(7): n is a, c, g, or t
  misc_feature (10)..(10): n is a, c, g, or t
  misc_feature (3199)..(3199): n is a, c, g, or t
  misc_feature (3207)..(3207): n is a, c, g, or t
  misc_feature (3216)..(3216): n is a, c, g, or t
nncacgngtncggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgcattatggatgatgccatcaacatcctgcagaatgaaaagtctcatcaagtcctagctcaactgctggatactttgcttgcaattggcactaagctaccagagaatcaagctatccaaatgcgattagttgatgtggcctgcaagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacaccaaaaagacaaaacataaaaaacttcgagaatagtcctctcanccctcatngtccccttntattcgcagggggttcccctaaggctaacggaggcgaaaattcagggggtattttacacttcgcgcg

SEQ ID NO: 358200 - DNA, 2138 bp, Homo sapiens
taagataatatctcaagacagaaaggaagggtcattccctttcatgcattgctcttttgatttgcaaaaacatccctgagaagctccccagccagcatactctcgtgctccattgtctagaactggcttacttgcccaccagcaaaccagtcactggaaaatgggaatgggattgccatgatgggtttagaccaatagtggttcagctcttgggctggacctgccttttccgagcactttgctgcctgcctgatacctgagtaaaatcagggctctctcaggaagaaagatgggggaaatggctcttggttaaataaccagttcttttatctttataataaccagtttttttagatgaattaaccgagttccagaataactgggtgacttatctgaagtcatagagttagcaaaagtatatggttgagaatttccaattccagttcaggttttctgattccagttcctagtacttttcaaaggactaactttactaatttgttgatgtgcattcttatttgtttgtttcaggtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacaccaa

SEQ ID NO: 358201 - DNA, 810 bp, Homo sapiens
ctgttcccggggaggcaaggcgggaggatcccttgagctcaggagtttgagaccagcctgagcaaaatctctaaaaaaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacaccaa

SEQ ID NO: 358202 - DNA, 972 bp, Homo sapiens
  misc_feature (1)..(2): n is a, c, g, or t
  misc_feature (7)..(7): n is a, c, g, or t
  misc_feature (10)..(10): n is a, c, g, or t
nncacgngtncggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaagagatggagtctctctgtgttgcccaggctggtcgcgaattcctgagctcaagcaaccctcctgcttggccctcccaaaggattgggattacagacgtgagctaccacatctgaccaaaatcaggatttctgttctcaagaagttttcgatctctcagtgatctattttccgttagtctttttcttagcaatatctaccattattattatattaaagatctattaccaataatcatctataataatacttcttagagcagttaacattatattgcttgttagagtttgaaagcactttccatatgtaatattttatttaatcctggtgacagcaccattgttatctctaaattccagatatggaactaagcttagagctgtttagtatccaaggtcacccagctagtaaatggaaggtatggatttgaacttgggttttttttttaaaaaaccttttgttatggaacatttcagatatatactatgtaagtaaagagaatagtttaattaattcccatgtacccattacctggcttcaaaaattatcattttgtggccaaacttgtttcattttccctcttccccaatccacttctacttctttaccctcaccttctccaccagattcttatgaaaataaattcctggcatcatattattttaatcataaattttgatttatatcttta

SEQ ID NO: 358203 - DNA, 258 bp, Homo sapiens
ttctcttgtatgaactactgataatttttacaaacgtaactctcaaagagcagttttattttctgccttcccatgttctcagggttcatcttagtgttccttcatgaacctcctacaattggtaattgttgttgtcctctgcagaggaaacgtactgcacatgagcgtgccaaggaactttacagttcgggggagttttccagtggcagaaagtggggagatgatgctcccaaggaagaagtagataccggggctgtg

SEQ ID NO: 358204 - DNA, 1860 bp, Homo sapiens
  misc_feature (1)..(2): n is a, c, g, or t
  misc_feature (7)..(7): n is a, c, g, or t
  misc_feature (10)..(10): n is a, c, g, or t
nncacgngtncggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgcattatggatgatgccatcaacatcctgcagaatgaaaagtctcatcaagtcctagctcaactgctggatactttgcttgcaattggcactaagctaccagagaatcaagctatccaaatgcgattagttgatgtggcctgcaagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtaatgacttttttgcccatttactcactgagtcccataatgtggtaaatgtataatgctgacatttgttccgtccttatagattgaggatagtacggccctgaattttgcctttactttagaaacctgattcaacttaaccgaactctcaggaatctgattcctaagctgagtatcacattttagattacttactaatttgtgcatctatccacctagcaaatattatgtgcctgctgtgtgctgactatgcaccaacccttgtggtagctgttacaagtatagaaataaattaattagatttcctc

SEQ ID NO: 358205 - DNA, 3163 bp, Homo sapiens
  misc_feature (1)..(2): n is a, c, g, or t
  misc_feature (7)..(7): n is a, c, g, or t
  misc_feature (10)..(10): n is a, c, g, or t
nncacgngtncggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgcattatggatgatgccatcaacatcctgcagaatgaaaagtctcatcaagtcctagctcaactgctggatactttgcttgcaattggcactaagctaccagagaatcaagctatccaaatgcgattagttgatgtggcctgcaagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggaaacatggtttcactgcgttgtccaggccagtcttgaactcctgaactcaaagtgtccttccacctcggcctcccaaagtgctaggattacagacgacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacaccaa

SEQ ID NO: 358206 - DNA, 3469 bp, Homo sapiens
  misc_feature (1)..(2): n is a, c, g, or t
  misc_feature (7)..(7): n is a, c, g, or t
  misc_feature (10)..(10): n is a, c, g, or t
  misc_feature (3406)..(3406): n is a, c, g, or t
nncacgngtncggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgcattatggatgatgccatcaacatcctgcagaatgaaaagtctcatcaagtcctagctcaactgctggatactttgcttgcaattggcactaagctaccagagaatcaagctatccaaatgcgattagttgatgtggcctgcaagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacaccaaaaaaaaaaaaaaaaccccgagacatagtcctctctccccctatttgtcccctttttaatcgcaagggcatccctaatgttgaccgaagaaaaatcttaggcctaattagcacttacgcaagggcccccaagttttgtaggcccctacggcgattattaaaaccctttgtaggagcgcataaaaatcttaccaaggacccctaaaaccggcatatttaccaataccttaaataacgcccgaatttagntctcaccaagctcttatattacccctcccaaatacaccctgttaaccaccaagccatttttac

SEQ ID NO: 358207 - DNA, 2342 bp, Homo sapiens
  misc_feature (1)..(2): n is a, c, g, or t
  misc_feature (7)..(7): n is a, c, g, or t
  misc_feature (10)..(10): n is a, c, g, or t
nncacgngtncggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgcattatggatgatgccatcaacatcctgcagaatgaaaagtctcatcaagtcctagctcaactgctggatactttgcttgcaattggcactaagctaccagagaatcaagctatccaaatgcgattagttgatgtggcctgcaagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgagggtaagatgtggggttggccaaaatatgtggcatgttcctttcaaagatacttcaaatgcattcagacatcacacga

SEQ ID NO: 358208 - DNA, 1525 bp, Homo sapiens
  misc_feature (1)..(2): n is a, c, g, or t
  misc_feature (7)..(7): n is a, c, g, or t
  misc_feature (10)..(10): n is a, c, g, or t
nncacgngtncggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgcattatggatgatgccatcaacatcctgcagaatgaaaagtctcatcaagtcctagctcaactgctggatactttgcttgcaattggcactaagctaccagagaatcaagctatccaaatgcgattagttgatgtggcctgcaagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacaccaa

SEQ ID NO: 358209 - DNA, 4338 bp, Homo sapiens
  misc_feature (991)..(991): n is a, c, g, or t
  misc_feature (4338)..(4338): n is a, c, g, or t
agtagagtaacaatattggctgagatttacacaaatttggtacatcataaatatttcaattttttttttttaattaggcagaattaagcaactcatagaacttgactacttgaacccaggcagtatacgcctctttattcttgatgaagcagataagcttttagaagaaggcagcttccaggagcaaataaattggatttattcttccttgcctgccagtaaacagatgctggcagtatcagctacttatcccgaatttttggctaatgctttgacaaagtacatgagagatcccacttttgtaagactgaattccagtgatccaagtctcataggtgtgtacagcttttaggtacttatattattggtttatttgtgatatgctggagctttcccttgcctagttttgtcttgctgtttcatggttaccattagcatatatatttgttttaactgatagctcttctttgtaggtttgaagcagtattacaaagttgtcaattcataccctttggcacataaggtttttgaggaaaagactcagcatttacaggaactgttcagcagaattccatttaatcaagctttagtcttttctaatttgcacagcaggtaatgtaacttaaaaggtcatctggggaacttgtgaaataaaaggatagtcatggggcaatatttgtaaatttgtaaccatttatgttatatttcatagagcacaacatttggctgatatcctttcttctaaaggctttcctgctgagtgcatttcaggtaagttcatctcttactttaatctttatttagtatactgacttgaagcctccaaagtcaggaggaaaaaataccactttatgagttgtcttgagagtgtgaaattatcttgtatcttttagagtaaaggaattttcaggcttatttttcattggaatttgatatgtcaatattctatttttaaggagtaacttggtatatagtaaaaagttagaaaacnagtgttcagaaagacaattttattagaatctctcttatagccacatataacttaattctataaaaccaagtttgtctgtattgtgttaagataaaaatattttttctttagaattttttttttaataattgttaaaatgctggagattgctaactgaattgactgttttatggttttgtggaaggcaaaagtgattgagttcttgctgcaaagttaaatgattactgctggcataataagaatgaaagagtcgaaggattttttgatcagtgagatcctttttagagttttgtttggtgtcagcttaatttttaacctgttggcatgagcttgtttagttatggtatatcacgagatactggggagactattttctaatgaaccaatacttaaactatagatcacactttaacaccaaattataaacagctgattaaagcatttttattttcctaagaattgctagttatacttcatatgtaactttgcaaatagaatgttatatattcaggcatggcctgatcactatttaggattgatttttgaatttcaagttgattgcctaaaccatagtttaaaagattttaactttggatcttaacctagatttgcacagaaggacagaattaactgtggttggtgtattaaaagtgttaagactgggtgttatgctttttactttttgtggattggataaatatgtattagcttagttgtttttatgtgactttcttttggggtccttttaggcaatatgaatcagaatcagcgtcttgatgctatggctaaactgaagcactttcattgcagagtcctcatttccacagatttggtaaatttcctattcagtttgggtgactaatccatcttgacatatgttctattatcagatgtacagatttcatatattattttatgtaggcgtatctaacaagaataccagaagataattatctttccagtgctgaggaaaatactttcttaaaaatgtctttaatatgtttatctttgtccttgaaattagtcattaggaatgaatttccttttcctctgctcctcagtattcagttcttaatttgtctcttgactgtactggaagaatataatatgcattggtatccatgctgtatagttaatgcaaacaaataattgctatcttcttcaattcaagacttctcgtgggattgatgctgagaaggtgaatctggttgtaaatctggatgtaccattggattgggagacatacatgcatcggattgggagagctggccgttttggtaaaaaaaaaaaaaaaagtttgagtgctttctttaaggggagggatctataatgtgacaggtgggctttgaatattatttttgtgaaaatgatttactacctaacattctctctgcttttaggtacattggggctgacagtgacctactgttgccggggagaggaagaaaatatgatgatgagaattgcccagaaatgtaatatcaaccttctccctttaccagatcccattccttctggtctgatggaagaatgtgtggattgggatgtggaagttaaagctgctgtgcatacatatggtatagcaagtgtacctaaccaacccttaaaaaagcaaattcagaaaatagagagaacccttcaaattcagaaagctcatggtgaccacatggcttcctctagaaataattctgtatctggactatcagtcaaatcaaaaaataataccaaacaaaagcttcctgtgaaaagccactcagaatgtggaatcatagaaaaagcaacgtcaccaaaagaactgggctgtgacaggcaatccgaagagcaaatgaagaattctgttcagactcccgttgaaaactccaccaacagtcagcaccaggtcaaagaagctttacctgtgtcactcccccagattccttgtctgtcttcctttaaaatccatcagccatacacgttgacttttgctgaattggtagaggattatgaacattatattaaagaggggttagagaaacctgtggaaatcatcaggcactacacaggccctggggatcagactgtgaatcctcaaaatggttttgtgagaaataaagttattgaacagagagtccctgtgttggcaagtagtagccaatctggagactctgagagtgacagtgattcttacagctcaagaacctcttcccagagcaaaggaaataagtcatacttggaaggctcttctgataatcagctgaaagactctgaatctacgcctgtggatgatcgtatttctttggaacaaccaccaaatggaagtgacacccccaatccagagaaatatcaagaatcacctggaatccagatgaagacaagacttaaagagggggctagccagagagctaagcagagccggagaaacctacccaggcggtcttccttcagattgcagactgaagcccaggaagatgattggtatgactgtcatagggaaatacgtctgagtttttctgatacctatcaggattatgaggagtactggagagcttactacagggcatggcaagaatattatgctgccgcttctcattcatattattggaatgctcagagacatccaagttggatggcagcttatcacatgaataccatttatctacaagaaatgatgcatagtaaccagtgattataggatatacctgagaccatcaggaactgtcaacaaatgatacctttggatatccatcctcctcgacttatagtacagtggtgtatagtggcatttctgataaacttgaaaagacttgagtctttccactgggacacatccatttttcagattgttttgatttaggccaggtatattatcttcatttttaagagtttctttaagaaacttcatcagattgttgaaagataatttttgggacatagagctgaaagtttcagggtgccattttctataagatcttcccaaaagaaacatttaaaaagatgacatataccaccacttacttaaaaacaataaaagcaatagatttgattagtaatattattgctgtggagttctttacaaagggcttaggctgcatttccttctatagaggtgcattcttgtagaaatttgtagcatggtagatcagaaaatcctcttaggttttaggcaggaaggaatatttaaacattgctttagattttcctaaaggtatttgatttgatctgttagcttccagtaaaaatatttgtttttagtaaaaacaaatttaaatatatttacatgtttgttgtttatcttttgaatgtcttttgaggctgtgaaagctgtccacatttttgctgtgtattaaatagctgtgggtcatcaaaan

SEQ ID NO: 358210 - DNA, 569 bp, Homo sapiens
caactagtatgttgcctagcacagagtaggttcttacttaatatttgttgaatgaatgaatgaatgaatggaatacagtcagccctccctgtcttcaggttttgtatcagctgattcagccaactgtggatcaaaatactcagggcaggatggaggaacaataaaaaataatacaacaatcaaaagatataaacaaaaatacggtgtaaccatttacatagcatttaaattgtattaggtattataaataatctagagatggtttaaaatatgtgggaggatgtacacaggtaatatacagatatatgcaattttatataacagacttgagcatctgccagttttggtatttgggggcttcctggaaccaatcccctgtggataccaagggataactgtaccttaccttatcaataaaaactcatttgaaatgatcatttaaatgaaatatagtgtgtcatgtaatgaatataccagtcccctatgtatttattcctctgactcaaaggtgtaatttatggtttttttttagattttgatcttggctcctacaagagaaattgctgtac

SEQ ID NO: 358211 - DNA, 3204 bp, Homo sapiens
atcacaaagaacggcgagagggcggtggcgccgggggcacggctgggcggctccgcccagaagagggccgagaggcggggcggtgcccccaccgcaggcccgcggcgccctctgcaggccacaggcagcgactcaccagttgcctcatctttcctctcctccctcttggggctttcctcaggccacattttctgtgtgtctgggcagtctctcagcctccgactcccgtccctttcttccacttccaggccgggcgtgttagtgtcttcgcgggaaaactgccaataaagtttttcttcttctcgctcccaagatccccgcctccccttaagcaccgcgagatctgacggcgcggctaccatggcggcggcatttgaagcctcgggagccttagcagcagtggcgactgctatgccggctgagcatgtggccgtgcaggtcccggccccagagccaacacccgggcctgtgaggatcctgcggaccgctcaggatctcagcagcccgcggacccgcacgggggatgtgctgttggcggagccggccgacttcgagtcactgctgctttcgcggccggtgctggaggggctgcgggcggccggcttcgagaggccctcgccggtgcagctcaaggccatcccgctggggcgctgcgggctcgatttaattgttcaagctaaatctggcaccgggaaaacctgtgtgttctccaccatagctttggactctcttgttcttgaaaacttaagtacccagattttgatcttggctcctacaagagaaattgctgtacagatacattctgttattacagccattggaataaaaatggaaggcttagagtgtcatgtctttattggagggaccccattatcacaagacaaaaccagacttaaaaagtgtcatattgctgttggatctcctggcagaattaagcaactcatagaacttgactacttgaacccaggcagtatacgcctctttattcttgatgaagcagataagcttttagaagaaggcagcttccaggagcaaataaattggatttattcttccttgcctgccagtaaacagatgctggcagtatcagctacttatcccgaatttttggctaatgctttgacaaagtacatgagagatcccacttttgtaagactgaattccagtgatccaagtctcataggtttgaagcagtattacaaagttgtcaattcataccctttggcacataaggtttttgaggaaaagactcagcatttacaggaactgttcagcagaattccatttaatcaagctttagtcttttctaatttgcacagcagagcacaacatttggctgatatcctttcttctaaaggctttcctgctgagtgcatttcaggcaatatgaatcagaatcagcgtcttgatgctatggctaaactgaagcactttcattgcagagtcctcatttccacagatttgacttctcgtgggattgatgctgagaaggtgaatctggttgtaaatctggatgtaccattggattgggagacatacatgcatcggattgggagagctggccgttttggtacattggggctgacagtgacctactgttgccggggagaggaagaaaatatgatgatgagaattgcccagaaatgtaatatcaaccttctccctttaccagatcccattccttctggtctgatggaagaatgtgtggattgggatgtggaagttaaagctgctgtgcatacatatggtatagcaagtgtacctaaccaacccttaaaaaagcaaattcagaaaatagagagaacccttcaaattcagaaagctcatggtgaccacatggcttcctctagaaataattctgtatctggactatcagtcaaatcaaaaaataataccaaacaaaagcttcctgtgaaaagccactcagaatgtggaatcatagaaaaagcaacgtcaccaaaagaactgggctgtgacaggcaatccgaagagcaaatgaagaattctgttcagactcccgttgaaaactccaccaacagtcagcaccaggtcaaagaagctttacctgtgtcactcccccagattccttgtctgtcttcctttaaaatccatcagccatacacgttgacttttgctgaattggtagaggattatgaacattatattaaagaggggttagagaaacctgtggaaatcatcaggcactacacaggccctggggatcagactgtgaatcctcaaaatggttttgtgagaaataaagttattgaacagagagtccctgtgttggcaagtagtagccaatctggagactctgagagtgacagtgattcttacagctcaagaacctcttcccagagcaaaggaaataagtcatacttggaaggctcttctgataatcagctgaaagactctgaatctacgcctgtggatgatcgtatttctttggaacaaccaccaaatggaagtgacacccccaatccagagaaatatcaagaatcacctggaatccagatgaagacaagacttaaagagggggctagccagagagctaagcagagccggagaaacctacccaggcggtcttccttcagattgcagactgaagcccaggaagatgattggtatgactgtcatagggaaatacgtctgagtttttctgatacctatcaggattatgaggagtactggagagcttactacagggcatggcaagaatattatgctgccgcttctcattcatattattggaatgctcagagacatccaagttggatggcagcttatcacatgaataccatttatctacaagaaatgatgcatagtaaccagtgattataggatatacctgagaccatcaggaactgtcaacaaatgatacctttggatatccatcctcctcgacttatagtacagtggtgtatagtggcatttctgataaacttgaaaagacttgagtctttccactgggacacatccatttttcagattgttttgatttaggccaggtatattatcttcatttttaagagtttctttaagaaacttcatcagattgttgaaagataatttttgggacatagagctgaaagtttcagggtgccattttctataagatcttcccaaaagaaacatttaaaaagatgacatataccaccacttacttaaaaacaataaaagcaatagatttgattagtaatatta

SEQ ID NO: 358212 - DNA, 3517 bp, Homo sapiens
  misc_feature (3517)..(3517): n is a, c, g, or t
atcacaaagaacggcgagagggcggtggcgccgggggcacggctgggcggctccgcccagaagagggccgagaggcggggcggtgcccccaccgcaggcccgcggcgccctctgcaggccacaggcagcgactcaccagttgcctcatctttcctctcctccctcttggggctttcctcaggccacattttctgtgtgtctgggcagtctctcagcctccgactcccgtccctttcttccacttccaggccgggcgtgttagtgtcttcgcgggaaaactgccaataaagtttttcttcttctcgctcccaagatccccgcctccccttaagcaccgcgagatctgacggcgcggctaccatggcggcggcatttgaagcctcgggagccttagcagcagtggcgactgctatgccggctgagcatgtggccgtgcaggtcccggccccagagccaacacccgggcctgtgaggatcctgcggaccgctcaggatctcagcagcccgcggacccgcacgggggatgtgctgttggcggagccggccgacttcgagtcactgctgctttcgcggccggtgctggaggggctgcgggcggccggcttcgagaggccctcgccggtgcagctcaaggccatcccgctggggcgctgcgggctcgatttaattgttcaagctaaatctggcaccgggaaaacctgtgtgttctccaccatagctttggactctcttgttcttgaaaacttaagtacccagattttgatcttggctcctacaagagaaattgctgtacagatacattctgttattacagccattggaataaaaatggaaggcttagagtgtcatgtctttattggagggaccccattatcacaagacaaaaccagacttaaaaagtgtcatattgctgttggatctcctggcagaattaagcaactcatagaacttgactacttgaacccaggcagtatacgcctctttattcttgatgaagcagataagcttttagaagaaggcagcttccaggagcaaataaattggatttattcttccttgcctgccagtaaacagatgctggcagtatcagctacttatcccgaatttttggctaatgctttgacaaagtacatgagagatcccacttttgtaagactgaattccagtgatccaagtctcataggtttgaagcagtattacaaagttgtcaattcataccctttggcacataaggtttttgaggaaaagactcagcatttacaggaactgttcagcagaattccatttaatcaagctttagtcttttctaatttgcacagcagagcacaacatttggctgatatcctttcttctaaaggctttcctgctgagtgcatttcaggcaatatgaatcagaatcagcgtcttgatgctatggctaaactgaagcactttcattgcagagtcctcatttccacagatttgacttctcgtgggattgatgctgagaaggtgaatctggttgtaaatctggatgtaccattggattgggagacatacatgcatcggattgggagagctggccgttttggtacattggggctgacagtgacctactgttgccggggagaggaagaaaatatgatgatgagaattgcccagaaatgtaatatcaaccttctccctttaccagatcccattccttctggtctgatggaagaatgtgtggattgggatgtggaagttaaagctgctgtgcatacatatggtatagcaagtgtacctaaccaacccttaaaaaagcaaattcagaaaatagagagaacccttcaaattcagaaagctcatggtgaccacatggcttcctctagaaataattctgtatctggactatcagtcaaatcaaaaaataataccaaacaaaagcttcctgtgaaaagccactcagaatgtggaatcatagaaaaagcaacgtcaccaaaagaactgggctgtgacaggcaatccgaagagcaaatgaagaattctgttcagactcccgttgaaaactccaccaacagtcagcaccaggtcaaagaagctttacctgtgtcactcccccagattccttgtctgtcttcctttaaaatccatcagccatacacgttgacttttgctgaattggtagaggattatgaacattatattaaagaggggttagagaaacctgtggaaatcatcaggcactacacaggccctggggatcagactgtgaatcctcaaaatggttttgtgagaaataaagttattgaacagagagtccctgtgttggcaagtagtagccaatctggagactctgagagtgacagtgattcttacagctcaagaacctcttcccagagcaaaggaaataagtcatacttggaaggctcttctgataatcagctgaaagactctgaatctacgcctgtggatgatcgtatttctttggaacaaccaccaaatggaagtgacacccccaatccagagaaatatcaagaatcacctggaatccagatgaagacaagacttaaagagggggctagccagagagctaagcagagccggagaaacctacccaggcggtcttccttcagattgcagactgaagcccaggaagatgattggtatgactgtcatagggaaatacgtctgagtttttctgatacctatcaggattatgaggagtactggagagcttactacagggcatggcaagaatattatgctgccgcttctcattcatattattggaatgctcagagacatccaagttggatggcagcttatcacatgaataccatttatctacaagaaatgatgcatagtaaccagtgattataggatatacctgagaccatcaggaactgtcaacaaatgatacctttggatatccatcctcctcgacttatagtacagtggtgtatagtggcatttctgataaacttgaaaagacttgagtctttccactgggacacatccatttttcagattgttttgatttaggccaggtatattatcttcatttttaagagtttctttaagaaacttcatcagattgttgaaagataatttttgggacatagagctgaaagtttcagggtgccattttctataagatcttcccaaaagaaacatttaaaaagatgacatataccaccacttacttaaaaacaataaaagcaatagatttgattagtaatattattgctgtggagttctttacaaagggcttaggctgcatttccttctatagaggtgcattcttgtagaaatttgtagcatggtagatcagaaaatcctcttaggttttaggcaggaaggaatatttaaacattgctttagattttcctaaaggtatttgatttgatctgttagcttccagtaaaaatatttgtttttagtaaaaacaaatttaaatatatttacatgtttgttgtttatcttttgaatgtcttttgaggctgtgaaagctgtccacatttttgctgtgtattaaatagctgtgggtcatcaaaan

SEQ ID NO: 358213 - DNA, 860 bp, Homo sapiens
tgtgcccgccctatgtttgagttttaaaaaattaatttaattgtggtaaaatatatgtaacataatatttaccatcttaaccatccgcctactgttttttagaggcacggtctcaccctgtcatgcagggtgtagtgcagtggtgcaatcatagctcactgcagcctcgaactcctgggctccagcaatactcctgcctcagcctccctagtagctgggagttccctctctggaggcctgttcccatttctccagagacaatgctgcatcacaatgttccagatctttcacaggtcattgacaggcatcctataggacttccccccaatacccccaccccgagaactctttcagtgggttctccagtgacttagaaacaaattttttccttggtggggttggctactcataccctctccttggcccttttctttgcttaattgaaaatagagatgggcacggtggctcaagcctgtaatcccagcactttgggaggctgagtctattatttttgaaatgttgaattctagcattttacgtatctgagattttaatcagcacctgttactaaggacctgtggccagtatgaatctctctgaaagccagagaagctctctagtcctcactgtagattttagtttctacttgtagggtgccttgtaaatttgcagtggcttcatgggtgttctttcttcttcttagatttgattgtagctgccacgagaacacaaattacatctaaaatttctatatccctctatttatgcagcacagagtaggagtcttaaacttgattttatctatagcactcataattttgagagagggggaagggaatactgccataagtactaaagtg

SEQ ID NO: 358214 - DNA, 4167 bp, Homo sapiens
cacagaggtgcagagaggtgacataacttccccaacatcacctgcttagtaagcatcatgggaggggcagagccacgtgacccaagcttatgaggaggctgtgggcccaccccagccacaagtcccagattctactggggaccgtcatcctttgtggggattgggagggtttggccaggagcacccctgggaagggcagattttagggggttcttctcaggctgaacctggcctggtctggtccacaggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaaggctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccggctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttgaatgtggagtgtttgtgtgtgttccttttttaaattaagttattccctcaat

SEQ ID NO: 358215 - DNA, 2009 bp, Homo sapiens
gagcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggtgagtccccgcttcactgcagggccactgagctctccagggccgactgtggtgaggcacccagagggattttgtccaagggacctcagcaatcagggaaggaggcacccccaaatccctgagctgtgtttgttggtgtattaaataaagtttttggactctt

SEQ ID NO: 358216 - DNA, 9304 bp, Homo sapiens
gttcctgatgtatccccagagtaggcttcgctcagagccacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaacgacaaccaccccacgtggaaggacgcaccctactacatcaacctggtggagatgacccctccagactctgacgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcgacgcctacaccagcacccaggccaaagccctcttcaagatagacgccatcacgggtgtgatcacagtccagggcctggtggaccgtgagaagggcgacttctataccttgacagtggtggcagatgacggcggccccaaggtggactccaccgtgaaggtctacatcactgtgctggacgagaatgacaacagcccccggtttgacttcacctccgactcggcggtcagcatacccgaggactgccctgtgggccagcgagtggctactgtcaaggcctgggaccctgatgctggcagcaatgggcaggtggtcttctccctggcctctggcaacatcgcgggggcctttgagatcgtcaccaccaatgactccattggcgaagtgtttgtggccaggcccctggacagagaagagctggatcactacatcctccaggttgtggcttctgaccgaggcacccctccacggaagaaggaccacatcctgcaggtgaccatcctggacatcaatgacaaccctccagtcatcgagagcccctttggatacaatgtcagtgtgaatgagaacgtgggtggaggtactgctgtggtccaggtgagagccactgaccgtgacatcgggatcaacagtgttctgtcctactacatcaccgagggcaacaaggacatgaccttccgcatggaccgcatcagcggtgagatcgccacacggcctgccccgcctgaccgcgagcgccagagcttctaccacctggtggccactgtggaggacgagggcaccccaaccctgtcggccaccacgcacgtgtacgtgaccattgtggatgagaatgataacgcgcccatgttccagcagccccactatgaggtgctgctggatgagggcccagacacgctcaacaccagcctcatcaccatccaggcactggacctggatgagggtcccaacggcacagtcacctatgccatcgtcgcaggcaacatcgtcaacaccttccgcatcgacagacacatgggtgtcatcactgctgccaaagagctggactacgagatcagccacggccgctacaccctgatcgtcactgccacagaccagtgccccatcttatcccaccgcctcacctctaccaccacggtgcttgtgaatgtgaatgacatcaacgacaatgtgcctaccttcccccgggactatgagggaccatttgaagtcactgagggccagccggggcccagagtgtggaccttcctggcccatgaccgagactcaggacccaacgggcaggtggagtacagcatcatggatggagaccctctgggggagtttgtgatctctcctgtggagggggtgctaagggtccggaaggacgtggagctggaccgggagaccatcgccttctacaacctgaccatctgtgcccgtgaccgggggatgcccccactcagctccacaatgctggtggggatccgggtgctggacatcaacgacaacgaccctgtgctgctgaacctgcccatgaacatcaccatcagcgagaacagccctgtctccagctttgtcgcccatgtcctggccagtgacgctgacagtggctgcaatgcacgcctcaccttcaacatcactgcgggcaaccgcgagcgggccttcttcatcaatgccacgacagggatcgtcactgtgaaccggcccctggaccgcgagcggatcccagagtacaagctgaccatttctgtgaaggacaacccggagaatccacgcatagccaggagggattatgacttgcttctgatcttcctttctgatgagaatgacaaccaccccctcttcactaaaagcacctaccaggcagaggtgatggaaaactctcccgctggcacccctctcacggtgctcaatgggcccatcctggccctggatgcagaccaagacatctacgccgtggtgacctaccagctgctgggtgcccagagtggcctctttgacatcaacagcagcaccggtgtggtgaccgtgaggtcaggtgtcatcattgaccgggaggcattctcgccacccatcctggagctgctgctgctggctgaggacatcgggctgctcaacagcacggcccacctgctcatcaccatcctggatgacaatgacaaccggcccacctttagccctgccaccctcactgtccatctgctagagaactgcccgcctggattctcagtccttcaagtcacagccacagatgaggacagtggcctcaatggggagctggtctaccgaatagaagctggggctcaggaccgcttcctcattcatctggtcaccggggtcatccgtgttggtaatgccaccatcgacagagaggagcaggagtcctacaggctaacggtggtggccaccgaccggggcaccgttcctctctcgggcacagccattgtcaccattctgatcgatgacatcaatgactcccgccccgagttcctcaaccccatccagacagtgagcgtgctggagtcggctgagccaggcactgtcattgccaatatcacggccattgaccacgacctcaacccaaagctagagtaccacattgtcggcattgtggccaaggacgacactgatcgcctggtgcccaaccaggaggacgcctttgctgtgaatatcaacacaggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagggctcgctgctgaaggtggtcctggaggattacctgcggctcaaaaagctctttgcacagcggatggtgcaaaaagcctcctcctgccactcctccatctctgagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccggctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttgaatgtggagtgtttgtgtgtgttccttttttaaattaagttattccctcaat

SEQ ID NO: 358217 - DNA, 7596 bp, Homo sapiens
gagcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaacgacaaccaccccacgtggaaggacgcaccctactacatcaacctggtggagatgacccctccagactctgacgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcaggaggaagacttggcctccccctgcatatctcccgccccacccagaagggcctttcagagtagcggggagaaagagacgtcacaatttcccggaaaggagttgagaagagagccagggcccagcaaggcccagaacagagctgctttcacagagcccttggccgaggctcccctcttgggaagtaaacaggcacaagaagaaagggctcctttgcccagggagcaggcgcaacagctccaaggctcagagggagagaagggaggaccctgaaaacaatttgggtgtgcacccacacctctgcccagaggcctcagttgctgggtggggagggaggcccggagtgaatgagtctctttaccaactatggggtttccgactcggaggctgagccaaacagggaatctgggcctgcccactggggcaggctcccgggcttgggagggacagaagcgtgggaggctggcaatgctcccctccctgcatcgggaccaggaggcgggcaggaaagggctggggagcagggagctgactcccagaaacacagagagcccagaaagccctgaggatttgcgagagtgtggtggctagctccagaaggaggaagtagagggttctctcgatcagggcctcagcttgtgaggacttggagcatacccccctggcctggtgcctgaaacccaattgagagccctccccctcctggacttttccttcttcaggcctcagggcagcctcaacccccaccccaacctccaggaagacagtgcctagtggccagcagggcctgctggtgaggtggatggctacaggctgaatccagcctaggatttgcagggaggccccaggggaagcaaaccaggaagaggttactgagcaggaagggaggaaggaacaaaacccttagggaggaggcctgccccactttctaaacccaaagacttggtttctatttacacaatactactcttactgaaatcctagagccagcgagttaatatagggcagccctgagttctcccatttctcagggagaaatgcagcgtctcaggatgacttctccaaggtcctcttggtaagtttcttgtgaagccggactcactttttgagatcagattgacttggaaggaagggacagtgggcttctccaatagagcctgcttggagagaaatctttctagagtcatctgagggaagatgaggctctgtgttatgccagcttccaccaagactcctgcctcagagggtggggacacacccaggctgggccacgcttcactctgtacacagaagcctcatacttctgtgcacagaactggggagtcaaagtgaggggctggacaatgtctggctctctgcaagctcccaagctggtaggaaagagaagacatagacaaaaaggacccatgctgccaagagaatgttccttttcctccccaagagaggtaggagacagtaggggcggctccaggcaggagggcttcacagagtgggtgtgtgtgaagcataagccacagttagtgggtgacaggtctttcagttttcctggagttttggatcaagatgaggctagaaagattaattggagccagctcccagagggcactgcacactgcgctgaggagctttggctatatccatttggcattagggagccagtgaaggttttggagctggggagtggcaagccagagctcactccttggggagacgtggctggctgcactgtgggtcacagcaggatgggggtggggcagctttgtggtgggatcctggccagctgactgggacaggagctgggcagcccaggtcctccctctgcccacccttcaaatttgggacctgaccaaagtgtttaaccctcgcgttgtgaggagaggtcaagggtttgggattctgagaagcccatcctggggtgggactgctttgacgggtcatcagcaaagcactcaccaaaaccacagatagcatccctagtgtgggcaggacttgggaccccacagctgtcctggagaggtccagaccatcccaccctcggggaggctgccgctttccctgggtgaggtgtggagctgctgtgagctgtcctcctccgagtccaggtggcatcacctccagctgctggaaatgccctgcctcttgccactctgtcacagcacccgccctggcctctgaagggagcctcctcgatcatcttcaatcccttcctgattgatcccaacgtgggtgccctgaagaggggccaccaagacggctgccaagaccatgcttggagagccctgtttgctcctcctcccagctggcacccaggcatctgttccaccaggagggaggcagctgctcccacagggcaccaggcagatgctggcagcacccgggaaacccaaggaagagagccccgaggttttgccccagcactgggccagcacagatgccaggacagtgtcttggccccggtgtaggctgagcatttcacttgactaaagggaacctttgccatttggcaacttctccatgctgggctttggcacctggagggcaaggcttctgtggcgagcgagggtgctgcttctaggaggtggttacgagccccaggttgtaccctgtggagcctcaggccaaaggcccagatgaccacgagtgcacatctcttgaccagaagtctttcatcaagcagcagcgagggggtctgcagagaggaaggtgctcttctgaggatcatctttgggaaagggcgctggcctgggcatgcaaggagcttcggggggtgagtgtgtgtcccagactgcttgggccactgtcttcctgcagcctgcagcaccggtctctgaagcaggaggatctacaggtagacctagggggatgtgggggcatgtttgtggacaccccattacatcttggtagattccatgtagtcacagtggctgcggttgtcctcggggcccggcaggggctgtcgagggacggtgggccggccatggcggaagctgtgcagggagaggcgcaaggagcccaggcgcttccagagccggagctggggctcactggggctcccagggtggtggggcatgcactcgtgagccctgcggcggctcgggtccagcgcggccggcttgcagagcgtcatgaacagcagacaggtggccagcaggaggaagatgcaggccagggcgatgagcatggggagggggtcagttgcctctgcaagggtcccgggagtgacgggagctgagagaaaggcgagggggctgatggctggggagctggcgaggctggggccctctgtgctcatggctcctgcaacagcaacaagacagaagctcaaaggcagatcagctggacccagggcagcgggtatagggaagacttacctagggaatgtggatgggggcaaggcactgttaaactggacagcatcatggccacatcacaggttaagacagcaaggtccagagacatcacaagtctaagtgtacacacagctgagcagtgatggagctgggcccaagctcaggccctcttcctgttccaccctgtgcccatctgccatgcagacaagagggcggtggcctgtccgcattttcaaatcaatcctcatgaatcatcacagggtcttaggcctggaaacttaagaccaactctgtcaataacttgctctgtggccaggaacgagttatggatggtaagaggccgcagctgccagggtccctagcagtaatctaataccaaagctgcaaactgggggcccacgggtgtgtttagttgggtccttgccatgtttttatcaatgtaattatgaatattttcaaaataataacagatttcacaaaaat

SEQ ID NO: 358218 - DNA, 2574 bp, Homo sapiens
gagcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggtgagtccccgcttcactgcagggccactgagctctccagggccgactgtggtgaggcacccagagggattttgtccaagggacctcagcaatcagggaaggaggcacccccaaatccctgagctgtgtttgttggtgtattaaataaagtttttggactcttcaggaaggggctcccttgacctaggttgcaatatggaaaaggagccaacctgaggggtgacgagactgagctgaggacactggttttctgcctttccccgagagagactcagtgagggtgggctgggagccctggaagccccctcaaatgggtgggaaggtgccagccatccttgagaagggcaaccctctccatgtgagcacaggcaccagagaggggcaggcgcctggagggtaccggggcacccccagctgcccatggctggacttgccctttgacaaggggccctcccagtgtcatttgtatctgtcagtactcttggttgcaagggacagaaacccttaagtagttcaagcaaaaaaggattggctcatgtaactcaaaagtataagtgatttcaggccgggctcggtggctcacgcctgtcatccaacaccttgagaaagccgaggtgggcggatcacttgaggtcgggagtttgagaccagcctggccaacatggcaaaaccccgtctctactagaaatacaaaaattagctgggcgtggtggcacgactgtaatccc

SEQ ID NO: 358219 - DNA, 295 bp, Homo sapiens
cagagtggcctctttgacatcaacagcagcaccggtgaggcctctgtgccacccagcactcccagcctgattctggggtggggatggccacactgctggattgagggcctcccttctcagtgctggacccaggctgtccgtggagaccccatttttcacagcccagagtccccatcttgcagctgggttatatcacccagtggcctggcagggggacgtgggaagaggcttggagacgatacacaggacctctgttggtgcacgaactctcagcctgggccgggagccccccagc

SEQ ID NO: 358220 - DNA, 11132 bp, Homo sapiens
gagcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaacgacaaccaccccacgtggaaggacgcaccctactacatcaacctggtggagatgacccctccagactctgacgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcgacgcctacaccagcacccaggccaaagccctcttcaagatagacgccatcacgggtgtgatcacagtccagggcctggtggaccgtgagaagggcgacttctataccttgacagtggtggcagatgacggcggccccaaggtggactccaccgtgaaggtctacatcactgtgctggacgagaatgacaacagcccccggtttgacttcacctccgactcggcggtcagcatacccgaggactgccctgtgggccagcgagtggctactgtcaaggcctgggaccctgatgctggcagcaatgggcaggtggtcttctccctggcctctggcaacatcgcgggggcctttgagatcgtcaccaccaatgactccattggcgaagtgtttgtggccaggcccctggacagagaagagctggatcactacatcctccaggttgtggcttctgaccgaggcacccctccacggaagaaggaccacatcctgcaggtgaccatcctggacatcaatgacaaccctccagtcatcgagagcccctttggatacaatgtcagtgtgaatgagaacgtgggtggaggtactgctgtggtccaggtgagagccactgaccgtgacatcgggatcaacagtgttctgtcctactacatcaccgagggcaacaaggacatgaccttccgcatggaccgcatcagcggtgagatcgccacacggcctgccccgcctgaccgcgagcgccagagcttctaccacctggtggccactgtggaggacgagggcaccccaaccctgtcggccaccacgcacgtgtacgtgaccattgtggatgagaatgataacgcgcccatgttccagcagccccactatgaggtgctgctggatgagggcccagacacgctcaacaccagcctcatcaccatccaggcactggacctggatgagggtcccaacggcacagtcacctatgccatcgtcgcaggcaacatcgtcaacaccttccgcatcgacagacacatgggtgtcatcactgctgccaaagagctggactacgagatcagccacggccgctacaccctgatcgtcactgccacagaccagtgccccatcttatcccaccgcctcacctctaccaccacggtgcttgtgaatgtgaatgacatcaacgacaatgtgcctaccttcccccgggactatgagggaccatttgaagtcactgagggccagccggggcccagagtgtggaccttcctggcccatgaccgagactcaggacccaacgggcaggtggagtacagcatcatggatggagaccctctgggggagtttgtgatctctcctgtggagggggtgctaagggtccggaaggacgtggagctggaccgggagaccatcgccttctacaacctgaccatctgtgcccgtgaccgggggatgcccccactcagctccacaatgctggtggggatccgggtgctggacatcaacgacaacgaccctgtgctgctgaacctgcccatgaacatcaccatcagcgagaacagccctgtctccagctttgtcgcccatgtcctggccagtgacgctgacagtggctgcaatgcacgcctcaccttcaacatcactgcgggcaaccgcgagcgggccttcttcatcaatgccacgacagggatcgtcactgtgaaccggcccctggaccgcgagcggatcccagagtacaagctgaccatttctgtgaaggacaacccggagaatccacgcatagccaggagggattatgacttgcttctgatcttcctttctgatgagaatgacaaccaccccctcttcactaaaagcacctaccaggcagaggtgatggaaaactctcccgctggcacccctctcacggtgctcaatgggcccatcctggccctggatgcagaccaagacatctacgccgtggtgacctaccagctgctgggtgcccagagtggcctctttgacatcaacagcagcaccggtgtggtgaccgtgaggtcaggtgtcatcattgaccgggaggcattctcgccacccatcctggagctgctgctgctggctgaggacatcgggctgctcaacagcacggcccacctgctcatcaccatcctggatgacaatgacaaccggcccacctttagccctgccaccctcactgtccatctgctagagaactgcccgcctggattctcagtccttcaagtcacagccacagatgaggacagtggcctcaatggggagctggtctaccgaatagaagctggggctcaggaccgcttcctcattcatctggtcaccggggtcatccgtgttggtaatgccaccatcgacagagaggagcaggagtcctacaggctaacggtggtggccaccgaccggggcaccgttcctctctcgggcacagccattgtcaccattctgatcgatgacatcaatgactcccgccccgagttcctcaaccccatccagacagtgagcgtgctggagtcggctgagccaggcactgtcattgccaatatcacggccattgaccacgacctcaacccaaagctagagtaccacattgtcggcattgtggccaaggacgacactgatcgcctggtgcccaaccaggaggacgcctttgctgtgaatatcaacacaggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagggctcgctgctgaaggtggtcctggaggattacctgcggctcaaaaagctctttgcacagcggatggtgcaaaaagcctcctcctgccactcctccatctctgagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccggctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttgaatgtggagtgtttgtgtgtgttccttttttaaattaagttattccctcaat

SEQ ID NO: 358221 - DNA, 3969 bp, Homo sapiens
  misc_feature (3965)..(3969): n is a, c, g, or t
gagcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaacgacaaccaccccacgtggaaggacgcaccctactacatcaacctggtggagatgacccctccagactctgacgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtgctgccccggcctccgcccacctgtgcaggcctcctggggccctgcctccacccctcccagatggacagccagactaggtgggggcaggtgagggtggaaaagaggtcagggctctactgttgggctttagcctctggtggtgcctcccgaggatttgctcctggctcttcccaagggctttgcagctggatcactctggactggctccctggggacctcctgaacctgttggttgcagggacggggagcatctaccaaggttcattctagagggaggtaaggccccatgattcctagggaggagccctgagccccactccccgccccaagtctgggtgacagagcagtgacttggaggaatgtggcctcatccttccttggggacctgttgagaattcccacctgtttagaggcagatggttttgatctccctaaatgaaatggttttagctcaaaaannnnn

SEQ ID NO: 358222 - DNA, 11086 bp, Homo sapiens
gagcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaacgacaaccaccccacgtggaaggacgcaccctactacatcaacctggtggagatgacccctccagactctgacgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcgacgcctacaccagcacccaggccaaagccctcttcaagatagacgccatcacgggtgtgatcacagtccagggcctggtggaccgtgagaagggcgacttctataccttgacagtggtggcagatgacggcggccccaaggtggactccaccgtgaaggtctacatcactgtgctggacgagaatgacaacagcccccggtttgacttcacctccgactcggcggtcagcatacccgaggactgccctgtgggccagcgagtggctactgtcaaggcctgggaccctgatgctggcagcaatgggcaggtggtcttctccctggcctctggcaacatcgcgggggcctttgagatcgtcaccaccaatgactccattggcgaagtgtttgtggccaggcccctggacagagaagagctggatcactacatcctccaggttgtggcttctgaccgaggcacccctccacggaagaaggaccacatcctgcaggtgaccatcctggacatcaatgacaaccctccagtcatcgagagcccctttggatacaatgtcagtgtgaatgagaacgtgggtggaggtactgctgtggtccaggtgagagccactgaccgtgacatcgggatcaacagtgttctgtcctactacatcaccgagggcaacaaggacatgaccttccgcatggaccgcatcagcggtgagatcgccacacggcctgccccgcctgaccgcgagcgccagagcttctaccacctggtggccactgtggaggacgagggcaccccaaccctgtcggccaccacgcacgtgtacgtgaccattgtggatgagaatgataacgcgcccatgttccagcagccccactatgaggtgctgctggatgagggcccagacacgctcaacaccagcctcatcaccatccaggcactggacctggatgagggtcccaacggcacagtcacctatgccatcgtcgcaggcaacatcgtcaacaccttccgcatcgacagacacatgggtgtcatcactgctgccaaagagctggactacgagatcagccacggccgctacaccctgatcgtcactgccacagaccagtgccccatcttatcccaccgcctcacctctaccaccacggtgcttgtgaatgtgaatgacatcaacgacaatgtgcctaccttcccccgggactatgagggaccatttgaagtcactgagggccagccggggcccagagtgtggaccttcctggcccatgaccgagactcaggacccaacgggcaggtggagtacagcatcatggatggagaccctctgggggagtttgtgatctctcctgtggagggggtgctaagggtccggaaggacgtggagctggaccgggagaccatcgccttctacaacctgaccatctgtgcccgtgaccgggggatgcccccactcagctccacaatgctggtggggatccgggtgctggacatcaacgacaacgaccctgtgctgctgaacctgcccatgaacatcaccatcagcgagaacagccctgtctccagctttgtcgcccatgtcctggccagtgacgctgacagtggctgcaatgcacgcctcaccttcaacatcactgcgggcaaccgcgagcgggccttcttcatcaatgccacgacagggatcgtcactgtgaaccggcccctggaccgcgagcggatcccagagtacaagctgaccatttctgtgaaggacaacccggagaatccacgcatagccaggagggattatgacttgcttctgatcttcctttctgatgagaatgacaaccaccccctcttcactaaaagcacctaccaggcagaggtgatggaaaactctcccgctggcacccctctcacggtgctcaatgggcccatcctggccctggatgcagaccaagacatctacgccgtggtgacctaccagctgctgggtgcccagagtggcctctttgacatcaacagcagcaccggtgtggtgaccgtgaggtcaggtgtcatcattgaccgggaggcattctcgccacccatcctggagctgctgctgctggctgaggacatcgggctgctcaacagcacggcccacctgctcatcaccatcctggatgacaatgacaaccggcccacctttagccctgccaccctcactgtccatctgctagagaactgcccgcctggattctcagtccttcaagtcacagccacagatgaggacagtggcctcaatggggagctggtctaccgaatagaagctggggctcaggaccgcttcctcattcatctggtcaccggggtcatccgtgttggtaatgccaccatcgacagagaggagcaggagtcctacaggctaacggtggtggccaccgaccggggcaccgttcctctctcgggcacagccattgtcaccattctgatcgatgacatcaatgactcccgccccgagttcctcaaccccatccagacagtgagcgtgctggagtcggctgagccaggcactgtcattgccaatatcacggccattgaccacgacctcaacccaaagctagagtaccacattgtcggcattgtggccaaggacgacactgatcgcctggtgcccaaccaggaggacgcctttgctgtgaatatcaacacaggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccggtacccggcgaccgtgccccacagccctagccgccctccccactgcccgggcttaccctggtcctgctcccgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagggctcgctgctgaaggtggtcctggaggattacctgcggctcaaaaagctctttgcacagcggatggtgcaaaaagcctcctcctgccactcctccatctctgagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccggctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttgaatgtggagtgtttgtgtgtgttccttttttaaattaagttattccctcaat

SEQ ID NO: 358223 - DNA, 388 bp, Homo sapiens
ccctgtgatgataaccggctgagacccgagccatttccacttcagatgggcatcgttcccacttgcctgtcacctttgctccctgctgtgccctgtgggcatttgtgccgcctcccctagatgtgcccacctaccccagggctcatgccccttcctggggattcggggcactgagtctctgagccgtaccccgcctttgggcttcctgcagggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgacc

SEQ ID NO: 358224 - DNA, 501 bp, Homo sapiens
cgaggctgccatcctggagaatctggcactgggtactgagattgtgcgggtccaggcctactccatcgacaacctcaaccaaatcacgtaccgcttcgacgcctacaccagcacccaggccaaagccctcttcaagatagacgccatcacggtgaggggctgggggcagggagcaccatttcttccaatctaaccaacattggttgagctccttctgtgtgcacagcactctcctctttgtcataaaatgtccttgagatggccaagtgtggtgttaggtacctgtagtcccagctgcttgagaggctggggcaggaagattgcttcagctcaggagtttggaggctgcagtgagctgcgtttgcaccactgcactccagcccgggcaacagagtgagaccttgtctcttacaaagaaacaaaaaaaagtccccgagatcaatatccctgtaacacatccattttcatatgtaggagtaagataaagtttatacctatgca

SEQ ID NO: 358225 - DNA, 224 bp, Homo sapiens
ggcttatcattgtagcaaatttaagctcattgcatttttggctgaatgttataattaatgtttgatttgcaaaagtctgatgttgaggtaatctaaaagaatcctttgaaaatttctttgtgttaagtatttatatatttatatgttatgtgatctgatatatgacaaagtctcataaaaatgttcgtacacagtagtaagcattctttaagatattcagagca

SEQ ID NO: 358226 - DNA, 2858 bp, Homo sapiens
acgcccacttccgcttcccgtgctgggggcggtggcagggccggtgggcggtggcggctcccggtctcggctcgggcacggccctgggcaggccgcccgccagccgcaggggcgctcctgagcttcgcggggccgcagtccgggatgcctgcgcgaagggaggggcgaagggccggccgttgccgacgtgggtgttaagtggccgccccagccggcgacccggagccgagagcgggcggcggagcctgagctggacgcggccacgccggcgcggcgggatatgtggtgcctgtcataagctccagagagctgccttccacaagaccagcagaagagtgggcaaacatgaaatccaatcctgctatccaggctgccattgacctcacagcgggggctgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgagtgatctgcagaatgcagccgccggttccttcgcctctgcctttgctgcactggtgctctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaacccattctagatgtagggtctgcttaatgtgtgtacttttctaagtggtggcacgtgcctgtagtcccagctactcaggaggctgaggcaggagaatcgcttgaacccgggaggcagaagttgcagtgaactgaaattgtgccactgcactccagactgggtgacacagcgagacttcatctcaaaaaaaaaaagaaaagaaaagcaattgtacttcactatgccatatgtatgtattcactgaccaaaaattcactgaccaaccaaccaaactccacacttcatctgatcccccatagacttggggatggacagctgttctttggccatatggtataagaggatcattcttgtcactacttaagttagcctcatcattttgtgctgctccaacaccagcagggtatctcccaataaagtgttcctaagcagcctgtatactgagtgcaagcaggctatcaattttaataatagtccataccatgtatgtgtttctgtcagcagaatgtacatgttgtacaaaacctccaggttccttaagctttttgctgtccatgaatcctctgtggcaactgtaatcacagagccagaagccagagggccagggatatgagaggctgacaaacatcaggggacatctggggaggagatccctgtcatgtctcttgtgccatggagctattatggctggtcttccatttgctttttctttaagtgaaaaccatttttctactttgcttttctctccatacttaaatggtcagtagctactgagtggtgctttatctgaataggcctggatcgaagtaaaatagaaatgggactggctttccacaggaagtaaactgcttcagagcccacagtcccctgctcagtgtccggaaagaagtcagtcatccctgttggcagtaaatcttcccacaggccgtccattagagatttaactagatatgttcaatagaaagagtctgaggcaagtggaaatgaggaacggaaacttaggttgggagaatattttttttttattcattctgtttgcttaattcagagtacagtttgtgctatttcatatctgtactccaggcagaaatataacttgaaaatactgtgtctaaagaaatttcagtgttctatcattaaattatttacttaataaaaaagtctgat

SEQ ID NO: 358227 - DNA, 2800 bp, Homo sapiens
acgcccacttccgcttcccgtgctgggggcggtggcagggccggtgggcggtggcggctcccggtctcggctcgggcacggccctgggcaggccgcccgccagccgcaggggcgctcctgagcttcgcggggccgcagtccgggatgcctgcgcgaagggaggggcgaagggccggccgttgccgacgtgggtgttaagtggccgccccagccggcgacccggagccgagagcgggcggcggagcctgagctggacgcggccacgccggcgcggcgggatatgtggtgcctgtcataagctccagagagctgccttccacaagaccagcagaagagtgggcaaacatgaaatccaatcctgctatccaggctgccattgacctcacagcgggggctgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgagtgatctgcagaatgcagccgccggttccttcgcctctgcctttgctgcactggtgctctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaacccattctagatgtagggtctgcttaatgtgtgtacttttctaagtggttgattattttttatttttttgatacagagtctcactcttgcactccagactgggtgacacagcgagacttcatctcaaaaaaaaaaagaaaagaaaagcaattgtacttcactatgccatatgtatgtattcactgaccaaaaattcactgaccaaccaaccaaactccacacttcatctgatcccccatagacttggggatggacagctgttctttggccatatggtataagaggatcattcttgtcactacttaagttagcctcatcattttgtgctgctccaacaccagcagggtatctcccaataaagtgttcctaagcagcctgtatactgagtgcaagcaggctatcaattttaataatagtccataccatgtatgtgtttctgtcagcagaatgtacatgttgtacaaaacctccaggttccttaagctttttgctgtccatgaatcctctgtggcaactgtaatcacagagccagaagccagagggccagggatatgagaggctgacaaacatcaggggacatctggggaggagatccctgtcatgtctcttgtgccatggagctattatggctggtcttccatttgctttttctttaagtgaaaaccatttttctactttgcttttctctccatacttaaatggtcagtagctactgagtggtgctttatctgaataggcctggatcgaagtaaaatagaaatgggactggctttccacaggaagtaaactgcttcagagcccacagtcccctgctcagtgtccggaaagaagtcagtcatccctgttggcagtaaatcttcccacaggccgtccattagagatttaactagatatgttcaatagaaagagtctgaggcaagtggaaatgaggaacggaaacttaggttgggagaatattttttttttattcattctgtttgcttaattcagagtacagtttgtgctatttcatatctgtactccaggcagaaatataacttgaaaatactgtgtctaaagaaatttcagtgttctatcattaaattatttacttaataaaaaagtctgat

SEQ ID NO: 358228 - DNA, 3069 bp, Homo sapiens
tttaagcataaataaatttcagttcattctctatttacatacacgttattaatcggtagagctcaaattaaagaggtttttctatagaatgaaatatttagctctttggggattaattagccagactccttgtttcctttccgtggtgccgggtctgatcagtcccactgggcattaggcaaagtgagcgatgaagtcttcccaggtctcccctccctttctgtggtttccgtttcttgtgcacacagtagctgctgtttactgattacgtagccggtgctgtgccaagcctgtctcctccatttttatttaatcctcacgctaaccctgtgaggtggcatggatgaggagctgaggctcagaagttacatggcttgtccaggatctcacagcaaagccatagtccctctgaccctattgcccaggctcctacatattcactgcactgtttgtcgctgttgaacacatgtctgtctctctcccctgcctggcatgagctccttcagggtgggacttagatgccaggcacatcaaggacctgctctaaattgtttactggacatggctggaaggttttggaggaaaagaggttgaaatgaaccgaagcaggggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgagtgatctgcagaatgcagccgccggttccttcgcctctgcctttgctgcactggtgctctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaacccattctagatgtagggtctgcttaatgtgtgtacttttctaagtggtggcacgtgcctgtagtcccagctactcaggaggctgaggcaggagaatcgcttgaacccgggaggcagaagttgcagtgaactgaaattgtgccactgcactccagactgggtgacacagcgagacttcatctcaaaaaaaaaaagaaaagaaaagcaattgtacttcactatgccatatgtatgtattcactgaccaaaaattcactgaccaaccaaccaaactccacacttcatctgatcccccatagacttggggatggacagctgttctttggccatatggtataagaggatcattcttgtcactacttaagttagcctcatcattttgtgctgctccaacaccagcagggtatctcccaataaagtgttcctaagcagcctgtatactgagtgcaagcaggctatcaattttaataatagtccataccatgtatgtgtttctgtcagcagaatgtacatgttgtacaaaacctccaggttccttaagctttttgctgtccatgaatcctctgtggcaactgtaatcacagagccagaagccagagggccagggatatgagaggctgacaaacatcaggggacatctggggaggagatccctgtcatgtctcttgtgccatggagctattatggctggtcttccatttgctttttctttaagtgaaaaccatttttctactttgcttttctctccatacttaaatggtcagtagctactgagtggtgctttatctgaataggcctggatcgaagtaaaatagaaatgggactggctttccacaggaagtaaactgcttcagagcccacagtcccctgctcagtgtccggaaagaagtcagtcatccctgttggcagtaaatcttcccacaggccgtccattagagatttaactagatatgttcaatagaaagagtctgaggcaagtggaaatgaggaacggaaacttaggttgggagaatattttttttttattcattctgtttgcttaattcagagtacagtttgtgctatttcatatctgtactccaggcagaaatataacttgaaaatactgtgtctaaagaaatttcagtgttctatcattaaattatttacttaataaaaaagtctgat

SEQ ID NO: 358229 - DNA, 2747 bp, Homo sapiens
acgcccacttccgcttcccgtgctgggggcggtggcagggccggtgggcggtggcggctcccggtctcggctcgggcacggccctgggcaggccgcccgccagccgcaggggcgctcctgagcttcgcggggccgcagtccgggatgcctgcgcgaagggaggggcgaagggccggccgttgccgacgtgggtgttaagtggccgccccagccggcgacccggagccgagagcgggcggcggagcctgagctggacgcggccacgccggcgcggcgggatatgtggtgcctgtcataagctccagagagctgccttccacaagaccagcagaagagtgggcaaacatgaaatccaatcctgctatccaggctgccattgacctcacagcgggggctgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgagtgatctgcagaatgcagccgccggttccttcgcctctgcctttgctgcactggtgctctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaacccattctagatgtagggtctgcttaatgtgtgtacttttctaagtggttgattattttttatttttttgatacagagtctcactcttgcactccagactgggtgacacagcgagacttcatctcaaaaaaaaaaagaaaagaaaagcaattgtacttcactatgccatatgtatgtattcactgaccaaaaattcactgaccaaccaaccaaactccacacttcatctgatcccccatagacttggggatggacagctgttctttggccatatggtataagaggatcattcttgtcactacttaagttagcctcatcattttgtgctgctccaacaccagcagggtatctcccaataaagtgttcctaagcagcctgtatactgagtgcaagcaggctatcaattttaataatagtccataccatgtatgtgtttctgtcagcagaatgtacatgttgtactgtaatcacagagccagaagccagagggccagggatatgagaggctgacaaacatcaggggacatctggggaggagatccctgtcatgtctcttgtgccatggagctattatggctggtcttccatttgctttttctttaagtgaaaaccatttttctactttgcttttctctccatacttaaatggtcagtagctactgagtggtgctttatctgaataggcctggatcgaagtaaaatagaaatgggactggctttccacaggaagtaaactgcttcagagcccacagtcccctgctcagtgtccggaaagaagtcagtcatccctgttggcagtaaatcttcccacaggccgtccattagagatttaactagatatgttcaatagaaagagtctgaggcaagtggaaatgaggaacggaaacttaggttgggagaatattttttttttattcattctgtttgcttaattcagagtacagtttgtgctatttcatatctgtactccaggcagaaatataacttgaaaatactgtgtctaaagaaatttcagtgttctatcattaaattatttacttaataaaaaagtctgat

SEQ ID NO: 358230 - DNA, 2504 bp, Homo sapiens
acgcccacttccgcttcccgtgctgggggcggtggcagggccggtgggcggtggcggctcccggtctcggctcgggcacggccctgggcaggccgcccgccagccgcaggggcgctcctgagcttcgcggggccgcagtccgggatgcctgcgcgaagggaggggcgaagggccggccgttgccgacgtgggtgttaagtggccgccccagccggcgacccggagccgagagcgggcggcggagcctgagctggacgcggccacgccggcgcggcgggatatgtggtgcctgtcataagctccagagagctgccttccacaagaccagcagaagagtgggcaaacatgaaatccaatcctgtctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaacccattctagatgtagggtctgcttaatgtgtgtacttttctaagtggtggcacgtgcctgtagtcccagctactcaggaggctgaggcaggagaatcgcttgaacccgggaggcagaagttgcagtgaactgaaattgtgccactgcactccagactgggtgacacagcgagacttcatctcaaaaaaaaaaagaaaagaaaagcaattgtacttcactatgccatatgtatgtattcactgaccaaaaattcactgaccaaccaaccaaactccacacttcatctgatcccccatagacttggggatggacagctgttctttggccatatggtataagaggatcattcttgtcactacttaagttagcctcatcattttgtgctgctccaacaccagcagggtatctcccaataaagtgttcctaagcagcctgtatactgagtgcaagcaggctatcaattttaataatagtccataccatgtatgtgtttctgtcagcagaatgtacatgttgtacaaaacctccaggttccttaagctttttgctgtccatgaatcctctgtggcaactgtaatcacagagccagaagccagagggccagggatatgagaggctgacaaacatcaggggacatctggggaggagatccctgtcatgtctcttgtgccatggagctattatggctggtcttccatttgctttttctttaagtgaaaaccatttttctactttgcttttctctccatacttaaatggtcagtagctactgagtggtgctttatctgaataggcctggatcgaagtaaaatagaaatgggactggctttccacaggaagtaaactgcttcagagcccacagtcccctgctcagtgtccggaaagaagtcagtcatccctgttggcagtaaatcttcccacaggccgtccattagagatttaactagatatgttcaatagaaagagtctgaggcaagtggaaatgaggaacggaaacttaggttgggagaatattttttttttattcattctgtttgcttaattcagagtacagtttgtgctatttcatatctgtactccaggcagaaatataacttgaaaatactgtgtctaaagaaatttcagtgttctatcattaaattatttacttaataaaaaagtctgat

SEQ ID NO: 358231 - DNA, 434 bp, Homo sapiens
agtggattgtatcaaatccagaattcaagttctttccatgtctggaaaacaggcaggatttatcagaacctttataaatgttgtgaaaaatgaaggtgagtaaatacctgtttttcaagcatctatatacatcttaaaatctgagatacgggccgggcgtggtggctcatgcctgtgatcccagcactttgggaggctgaggcaggtggatcatgaggtcaggagatcgagaccatcctggctaacacggtgaaaccccgtctctactaaaaataccaaaaaaatcagccaggcgtggtggcaggcacctgtagtcccagctactcgggaggctgagacaggagaatggcgtcaacctgggaggcggagcttgcagtgagctgagattgcaccactgcactccagcctgggcaacagcgagactctgtctcaaa

SEQ ID NO: 358232 - DNA, 523 bp, Homo sapiens
gtaagttctggggtaggctgcctgtgccttccttccatggataatggaactgtagcctcgtactagagcagtcatctgtcctgattgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgaggtgagtcaaggacacacactttttttatttgtttaaaaaaaccccacaaaactggcaagacatggtggctcatgcctgtaatcccagcactttgggaggcaaaggcaggaaaatggcttgaggctgagagttcaaaaccagcctgggcaacacagcaagatcctcatctctaca

SEQ ID NO: 358233 - DNA, 471 bp, Homo sapiens
aagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaacccattctagatgtagggtctgcttaatgtgtgtacttttctaagtggttgattattttttatttttttgatacagagtctcactctgtcacccagactggagtgcagtggcacgatctcggctcactgcaacctccgcctcctgggttcaagcgattctctcacctcagcctcctgagtagctgggattacaggtacgcgccaccatgtccagctaattttttttggtattttttgta

SEQ ID NO: 358234 - DNA, 1694 bp, Homo sapiens
acgcccacttccgcttcccgtgctgggggcggtggcagggccggtgggcggtggcggctcccggtctcggctcgggcacggccctgggcaggccgcccgccagccgcaggggcgctcctgagcttcgcggggccgcagtccgggatgcctgcgcgaagggaggggcgaagggccggccgttgccgacgtgggtgttaagtggccgccccagccggcgacccggagccgagagcgggcggcggagcctgagctggacgcggccacgccggcgcggcgggatatgtggtgcctgtcataagctccagagagctgccttccacaagaccagcagaagagtgggcaaacatgaaatccaatcctgctatccaggctgccattgacctcacagcgggggctgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgagtgatctgcagaatgcagccgccggttccttcgcctctgcctttgctgcactggtgctctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaaccc

SEQ ID NO: 358235 - DNA, 3235 bp, Homo sapiens
tttaagcataaataaatttcagttcattctctatttacatacacgttattaatcggtagagctcaaattaaagaggtttttctatagaatgaaatatttagctctttggggattaattagccagactccttgtttcctttccgtggtgccgggtctgatcagtcccactgggcattaggcaaagtgagcgatgaagtcttcccaggtctcccctccctttctgtggtttccgtttcttgtgcacacagtagctgctgtttactgattacgtagccggtgctgtgccaagcctgtctcctccatttttatttaatcctcacgctaaccctgtgaggtggcatggatgaggagctgaggctcagaagttacatggcttgtccaggatctcacagcaaagccatagtccctctgaccctattgcccaggctcctacatattcactgcactgtttgtcgctgttgaacacatgtctgtctctctcccctgcctggcatgagctccttcagggtgggacttagatgccaggcacatcaaggacctgctctaaattgtttactggacatggctggaaggttttggaggaaaagaggttgaaatgaaccgaagcaggggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgaggttaacagagagtccctgagggaggccaactgtggatctgcaggctggctgcaagacaacagaaaccattttaagcttcagttctaacaagctgctaaggagtgaagtgggggaaaggagtggactgaacagcattggatggtttccacaccccataaaagcgtgttgatctgcagaatgcagccgccggttccttcgcctctgcctttgctgcactggtgctctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaacccattctagatgtagggtctgcttaatgtgtgtacttttctaagtggtggcacgtgcctgtagtcccagctactcaggaggctgaggcaggagaatcgcttgaacccgggaggcagaagttgcagtgaactgaaattgtgccactgcactccagactgggtgacacagcgagacttcatctcaaaaaaaaaaagaaaagaaaagcaattgtacttcactatgccatatgtatgtattcactgaccaaaaattcactgaccaaccaaccaaactccacacttcatctgatcccccatagacttggggatggacagctgttctttggccatatggtataagaggatcattcttgtcactacttaagttagcctcatcattttgtgctgctccaacaccagcagggtatctcccaataaagtgttcctaagcagcctgtatactgagtgcaagcaggctatcaattttaataatagtccataccatgtatgtgtttctgtcagcagaatgtacatgttgtacaaaacctccaggttccttaagctttttgctgtccatgaatcctctgtggcaactgtaatcacagagccagaagccagagggccagggatatgagaggctgacaaacatcaggggacatctggggaggagatccctgtcatgtctcttgtgccatggagctattatggctggtcttccatttgctttttctttaagtgaaaaccatttttctactttgcttttctctccatacttaaatggtcagtagctactgagtggtgctttatctgaataggcctggatcgaagtaaaatagaaatgggactggctttccacaggaagtaaactgcttcagagcccacagtcccctgctcagtgtccggaaagaagtcagtcatccctgttggcagtaaatcttcccacaggccgtccattagagatttaactagatatgttcaatagaaagagtctgaggcaagtggaaatgaggaacggaaacttaggttgggagaatattttttttttattcattctgtttgcttaattcagagtacagtttgtgctatttcatatctgtactccaggcagaaatataacttgaaaatactgtgtctaaagaaatttcagtgttctatcattaaattatttacttaataaaaaagtctgat

SEQ ID NO: 358236 - DNA, 3024 bp, Homo sapiens
acgcccacttccgcttcccgtgctgggggcggtggcagggccggtgggcggtggcggctcccggtctcggctcgggcacggccctgggcaggccgcccgccagccgcaggggcgctcctgagcttcgcggggccgcagtccgggatgcctgcgcgaagggaggggcgaagggccggccgttgccgacgtgggtgttaagtggccgccccagccggcgacccggagccgagagcgggcggcggagcctgagctggacgcggccacgccggcgcggcgggatatgtggtgcctgtcataagctccagagagctgccttccacaagaccagcagaagagtgggcaaacatgaaatccaatcctgctatccaggctgccattgacctcacagcgggggctgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgaggttaacagagagtccctgagggaggccaactgtggatctgcaggctggctgcaagacaacagaaaccattttaagcttcagttctaacaagctgctaaggagtgaagtgggggaaaggagtggactgaacagcattggatggtttccacaccccataaaagcgtgttgatctgcagaatgcagccgccggttccttcgcctctgcctttgctgcactggtgctctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaacccattctagatgtagggtctgcttaatgtgtgtacttttctaagtggtggcacgtgcctgtagtcccagctactcaggaggctgaggcaggagaatcgcttgaacccgggaggcagaagttgcagtgaactgaaattgtgccactgcactccagactgggtgacacagcgagacttcatctcaaaaaaaaaaagaaaagaaaagcaattgtacttcactatgccatatgtatgtattcactgaccaaaaattcactgaccaaccaaccaaactccacacttcatctgatcccccatagacttggggatggacagctgttctttggccatatggtataagaggatcattcttgtcactacttaagttagcctcatcattttgtgctgctccaacaccagcagggtatctcccaataaagtgttcctaagcagcctgtatactgagtgcaagcaggctatcaattttaataatagtccataccatgtatgtgtttctgtcagcagaatgtacatgttgtacaaaacctccaggttccttaagctttttgctgtccatgaatcctctgtggcaactgtaatcacagagccagaagccagagggccagggatatgagaggctgacaaacatcaggggacatctggggaggagatccctgtcatgtctcttgtgccatggagctattatggctggtcttccatttgctttttctttaagtgaaaaccatttttctactttgcttttctctccatacttaaatggtcagtagctactgagtggtgctttatctgaataggcctggatcgaagtaaaatagaaatgggactggctttccacaggaagtaaactgcttcagagcccacagtcccctgctcagtgtccggaaagaagtcagtcatccctgttggcagtaaatcttcccacaggccgtccattagagatttaactagatatgttcaatagaaagagtctgaggcaagtggaaatgaggaacggaaacttaggttgggagaatattttttttttattcattctgtttgcttaattcagagtacagtttgtgctatttcatatctgtactccaggcagaaatataacttgaaaatactgtgtctaaagaaatttcagtgttctatcattaaattatttacttaataaaaaagtctgat

SEQ ID NO: 358237 - DNA, 2745 bp, Homo sapiens
acgcccacttccgcttcccgtgctgggggcggtggcagggccggtgggcggtggcggctcccggtctcggctcgggcacggccctgggcaggccgcccgccagccgcaggggcgctcctgagcttcgcggggccgcagtccgggatgcctgcgcgaagggaggggcgaagggccggccgttgccgacgtgggtgttaagtggccgccccagccggcgacccggagccgagagcgggcggcggagcctgagctggacgcggccacgccggcgcggcgggatatgtggtgcctgtcataagctccagagagctgccttccacaagaccagcagaagagtgggcaaacatgaaatccaatcctgctatccaggctgccattgacctcacagcgggggctgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgagtgatctgcagaatgcagccgccggttccttcgcctctgcctttgctgcactggtgctctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaacccattctagatgtagggtctgcttaatgtgtgtacttttctaagtggttgattattttttatttttttgatacagagtctcactcttgcactccagactgggtgacacagcgagacttcatctcaaaaaaaaaaagaaaagaaaagcaattgtacttcactatgccatatgtatgtattcactgaccaaaaattcactgaccaaccaaccaaactccacacttcatctgatcccccatagacttggggatggacagctgttctttggccatatggtataagaggatcattcttgtcactacttaagttagcctcatcattttgtgctgctccaacaccagcagggtatctcccaataaagtgttcctaagcagcctgtatactgagtgcaagcaggctatcaattttaataatagtccataccatgtatgtgtttctgtcagcagaatgtacatgttgtacaaaacctccaggttccttaagctttttgctgtccatgaatcctctgtggcaactgtaatcacagagccagaagccagagggccagggatatgagaggctgacaaacatcaggggacatctggggaggagatccctgtcatgtctcttgtgccatggagctattatggctggtcttccatttgctttttctttaagtgaaaaccatttttctactttgcttttctctccatacttaaatggtcagtagctactgagtggtgctttatctgaataggcctggatcgaaagtcccctgctcagtgtccggaaagaagtcagtcatccctgttggcagtaaatcttcccacaggccgtccattagagatttaactagatatgttcaatagaaagagtctgaggcaagtggaaatgaggaacggaaacttaggttgggagaatattttttttttattcattctgtttgcttaattcagagtacagtttgtgctatttcatatctgtactccaggcagaaatataacttgaaaatactgtgtctaaagaaatttcagtgttctatcattaaattatttacttaataaaaaagtctgat

SEQ ID NO: 358238 - DNA, 335 bp, Homo sapiens
tattatatatatgatcaaaagttttaataaggggtactttaacagaaaacaattctagtccagtgtgttctggaatagtagccccaaaataactagtccaaataacatgttcaaatatttgaagacaattttaaattcttttctaaaatccttggaagacatgcctctccaaataggcatctcaaatgagttaatatatattacagaataaaatatatactctaaacagtgactctcaaacaggggtgacttcatcacccataggaaatatagcactgtctggaaacaaaccaagggtgccactggtatctagtgggaagaggtcagggatacta

SEQ ID NO: 358239 - DNA, 987 bp, Homo sapiens
tcgccctcccaccccctagccatgcagaggtgaatgggggaacccaggaggggctgagagctccaggccaccttgagggaatccacgaggtcttctaccaggaagaagtgccgcagctgcgtggccgccgagaccacgcgggaggtgatctggtgggacaaacgttccgtctgctcccgagtcagggtgaggtccacatccagggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaggccactgtcattgctgaagtttattctcagatctgccaggtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaataaagcccagcccaaatcgaaaaaaaaaaaaaaaaaaaaaaaaaacaaaaaaacccaaccaaatgtttttgaaatattcagagccgaacagattctgagagataacccagtccaataacctctttccttcttattactcatctgtttttgaggggaagtagagttttgattattaaactttatttacataagtgattccaaatacattttcttgtaaaaaa

SEQ ID NO: 358240 - DNA, 880 bp, Homo sapiens
taggggaagagggaaggaggcctggagtctggcgagggacttgggagaggatggtgaacgagccacggcagagaggatgagagcgtggatccctggggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaggccactgtcattgctgaagtttattctcagatctgccaggtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaataaagcccagcccaaatcgaaaaaaaaaaaaaaaaaaaaaaaaaacaaaaaaacccaaccaaatgtttttgaaatattcagagccgaacagattctgagagataacccagtccaataacctctttccttcttattactcatctgtttttgaggggaagtagagttttgattattaaactttatttacataagtgattccaaatacattttcttgtaaaaaa

SEQ ID NO: 358241 - DNA, 410 bp, Homo sapiens
gaaaaggaagaggtgccaggagacaagacagaatttctcattaccttctcccacattttgtgttacagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaataaagcccagatgcggccgtttttcttatctcctaatccccccgaatccacgcctcacactcta

SEQ ID NO: 358242 - DNA, 898 bp, Homo sapiens
gagagttagtggaagggacttaagagaaagggcgtggtcttttggaaaggggcgattctgggtcgtaggagccgggccggaagtattgattagtgctggaaggtggaagagcagggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaggccactgtcattgctgaagtttattctcagatctgccaggtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaataaagcccagcccaaatcgaaaaaaaaaaaaaaaaaaaaaaaaaacaaaaaaacccaaccaaatgtttttgaaatattcagagccgaacagattctgagagataacccagtccaataacctctttccttcttattactcatctgtttttgaggggaagtagagttttgattattaaactttatttacataagtgattccaaatacattttcttgtaaaaaa

SEQ ID NO: 358243 - DNA, 828 bp, Homo sapiens
tcgccctcccaccccctagccatgcagaggtgaatgggggaacccaggaggggctgagagctccaggccaccttgagggaatccacgaggtcttctaccaggaagaagtgccgcagctgcgtggccgccgagaccacgcgggaggtgatctggtgggacaaacgttccgtctgctcccgagtcagggtgaggtccacatccagggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaggccactgtcattgctgaagtttattctcagatctgccaggtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaataaagcccgatgcggccagactataactacgaaaagaacgcagtgaggaataagaaaagaaa

SEQ ID NO: 358244 - DNA, 926 bp, Homo sapiens
tcgccctcccaccccctagccatgcagaggtgaatgggggaacccaggaggggctgagagctccaggccaccttgagggaatccacgaggtcttctaccaggaagaagtgccgcagctgcgtggccgccgagaccacgcgggaggtgatctggtgggacaaacgttccgtctgctcccgagtcagggtgaggtccacatccagggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaataaagcccagcccaaatcgaaaaaaaaaaaaaaaaaaaaaaaaaacaaaaaaacccaaccaaatgtttttgaaatattcagagccgaacagattctgagagataacccagtccaataacctctttccttcttattactcatctgtttttgaggggaagtagagttttgattattaaactttatttacataagtgattccaaatacattttcttgtaaaaaa

SEQ ID NO: 358245 - DNA, 567 bp, Homo sapiens
gaaaaggaagaggtgccaggagacaagacagaatttctcattaccttctcccacattttgtgttacagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaataaagcccagcccaaatcgaaaaaaaaaaaaaaaaaaaaaaaaaacaaaaaaacccaaccaaatgtttttgaaatattcagagccgaacagattctgagagataacccagtccaataacctctttccttcttattactcatctgtttttgaggggaagtagagttttgattattaaactttatttacataagtgattccaaatacattttcttgtaaaaaa

SEQ ID NO: 358246 - DNA, 767 bp, Homo sapiens
tcgccctcccaccccctagccatgcagaggtgaatgggggaacccaggaggggctgagagctccaggccaccttgagggaatccacgaggtcttctaccaggaagaagtgccgcagctgcgtggccgccgagaccacgcgggaggtgatctggtgggacaaacgttccgtctgctcccgagtcagggtgaggtccacatccagggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaataaagcccgatgcggccagactataactacgaaaagaacgcagtgaggaataagaaaagaaa

SEQ ID NO: 358247 - DNA, 1183 bp, Homo sapiens
gcggccgcacgggggtgccgaggcgtctggggggcctgcgcttcggggcgagcgcagcgcaaggctggcgcgcgcgcatggaggatgctcactgcacttggctttcgttacctggtctgcccccgggctgggccttgtttgccgtcctcgacggccacggtggggctcgagctgcccgcttcggtgcacgccatttgccaggccatgtgctccaggagctgggcccggagcctagcgagcccgagggcgtgcgcgaggcgctgcgccgagccttcttgagcgccgacgagcgcctgcgctccctctggccccgcgtggaaacgggcggctgcacggccgtggtgttgctggtctccccgcggtttctgtacctggcgcactgcggtgactcccgcgcggtgctgagccgcgctggcgccgtggccttcagcacagaggaccaccggccccttcgaccccgggaacgcgagcgcatccacgccgctggcggcaccatccgccgccgccgcgtcgagggctctctggccgtgtcgcgagcgttgggcgactttacctacaaggaggctccggggaggccccccgagctacagctcgtttctgcggagccagaggtggccgcactggcacgccaggctgaggacgagttcatgctcctggcctctgatggcgtctgggacactgtgtctggtgctgcctggcgggactggtggcttcacgcctccgcttgggcctggccccagagcttctctgcgcgcactgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaataaagcccagcccaaatcgaaaaaaaaaaaaaaaaaaaaaaaaaacaaaaaaacccaaccaaatgtttttgaaatattcagagccgaacagattctgagagataacccagtccaataacctctttccttcttattactcatctgtttttgaggggaagtagagttttgattattaaactttatttacataagtgattccaaatacattttcttgtaaaaaa

SEQ ID NO: 358248 - DNA, 838 bp, Homo sapiens
tcgccctcccaccccctagccatgcagaggtgaatgggggaacccaggaggggctgagagctccaggccaccttgagggaatccacgaggtcttctaccaggaagaagtgccgcagctgcgtggccgccgagaccacgcgggaggtgatctggtgggacaaacgttccgtctgctcccgagtcagggtgaggtccacatccagggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaggccactgtcattgctgaagtttattctcagatctgccaggtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaataaagcccagcgtaggcgcgccgaaacacttctcggcctcacatgccacgcacgtcccggactacgcaatat

SEQ ID NO: 358249 - DNA, 956 bp, Homo sapiens
tcgccctcccaccccctagccatgcagaggtgaatgggggaacccaggaggggctgagagctccaggccaccttgagggaatccacgaggtcttctaccaggaagaagtgccgcagctgcgtggccgccgagaccacgcgggaggtgatctggtgggacaaacgttccgtctgctcccgagtcagggtgaggtccacatccagggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaatctgccaggtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaataaagcccagcccaaatcgaaaaaaaaaaaaaaaaaaaaaaaaaacaaaaaaacccaaccaaatgtttttgaaatattcagagccgaacagattctgagagataacccagtccaataacctctttccttcttattactcatctgtttttgaggggaagtagagttttgattattaaactttatttacataagtgattccaaatacattttcttgtaaaaaa

SEQ ID NO: 358250 - DNA, 3915 bp, Homo sapiens
gcggccgcagctccgtttccggtggctcgtcgcgctcgctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358251 - DNA, 638 bp, Homo sapiens
gggttgttttgaggaaaggaaaccagggaaaccttaaatttttaatcccggcggggtgtcttgatccctttaaaaggggaaatgtttaagcaacggcgccaacccccccagattttagacgtgttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358252 - DNA, 618 bp, Homo sapiens
agcctgtccatatgggttggacgaggatatgttgttttttaaaatatcttatttttataagctctcacatccagtatgcagttatttattccaaatactttccctccttacctccccccacctcccttgctgcttagatggtggtctgtcggagaatcaatgttctttttgtctacccatctcccttcagtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttgtaagtgtttgatcttcaagattccttgctgtttgatctatatgatttggttaatggctctgatgtcttttggttttctagaatgttaatagaaatttacccaagtcggtgaactgaaggacatctaagatattttgtttagttcagttaatatttgcacacacaatgaatgtgtgacaggaaggatgtataagcagtcgtccaaccatatggaccat

SEQ ID NO: 358253 - DNA, 637 bp, Homo sapiens
atttacaactttaacaggttctttaatgttttatagccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagaggtaagttgtactttaagaacaactgaatggattcttgccttgagcctcaaacctgcagtttgggaaacttttttctgaagactcatgaaattaagctcaaacccccaacctcacacctcacaaagtgttgtcactggcagaaatgggcaggcagtgatcctgtggcagtcaggaagaataagaaaaccatgttctatcttaccacagttcctcactaaaac

SEQ ID NO: 358254 - DNA, 351 bp, Homo sapiens
gggggggccaaaaaaacccccctcttccctccggggttttttaaaaaaaaccccaattgtgttttataaacaaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358255 - DNA, 296 bp, Homo sapiens
gaagaagaggaagaagcagcgatattttcttttttcctttgggactgactgtcactcttgctggactcagcctggtttgcaattgcgcgatcttggacattccttgctgtttgatctatatgatttggttaatggctctgatgtcttttggttttctagaatgttaatagaaatttacccaagtcggtgaactgaaggacatctaagatattttgtttagttcagttaatatttgcacacacaatgaatgtgtgacaggaaggatgtataagcagtcgtccaaccatatggaccat

SEQ ID NO: 358256 - DNA, 4440 bp, Homo sapiens
ttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358257 - DNA, 4154 bp, Homo sapiens
cgcccagtggagcctgtccggcccccttgctgcccgctagctcccgccggctggcgcaagctgtcggcgccggggcactgcgggcggggtcggagcctggccttcctgacgttgcagctgccgtccccgcacgttccggccagggcctccctcttagggccgggcggtgcccgtggctcaggctgcagagtagaaagcacaaaaaccagcctgattgtatctggaaaaaaccattatgttacagttgataggctcaccccaaaatatgcttttggggactgatttagcacctgcatattctgcgtgaatctctttaattggttgcagttgagctaatggtggagccaaaatgctattgccctgtcttcatcaacatttaatcaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358258 - DNA, 4231 bp, Homo sapiens
ttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358259 - DNA, 4712 bp, Homo sapiens
ttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaaaatgcaagatttgtttttacatagccttttgccatacaattataaaaatttcatttcaaaagtgaaatttttttgtgctgttttagctttaagggttggaatgtttaggtgcaacatcagctccttaaagaaaaagcaaagtgatctaggatatgtctcccttgcaagagggaattaacatttacaattaacatgaaaatcatgtatcagacttctgcaggagattcttcagcataccttatccaaaaattactcactgtcctaatgtatca

SEQ ID NO: 358260 - DNA, 2457 bp, Homo sapiens
agcctgtccatatgggttggacgaggatatgttgttttttaaaatatcttatttttataagctctcacatccagtatgcagttatttattccaaatactttccctccttacctccccccacctcccttgctgcttagatggtggtctgtcggagaatcaatgttctttttgtctacccatctcccttcagtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358261 - DNA, 4642 bp, Homo sapiens
ttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacaggtactgtaatataatacttactatgtgcctgataaattttagatggaaaaaaacagacatttaattaacttgtttcagtctttcttgatccaataagctactagtcctgttgagttctacactgtggtagaataccttaaattcttgacatggattagagaataaatatatacatttaagactaacttgaaactcattacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358262 - DNA, 4386 bp, Homo sapiens
ttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358263 - DNA, 3223 bp, Homo sapiens
ttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagaggtaagttgtactttaagaacaactgaatggattcttgccttgagcctcaaacctgcagtttgggaaacttttttctgaagactcatgaaattaagctcaaacccccaacctcacacctcacaaagtgttgtcactggcagaaatgggcaggcagtgatcctgtggcagtcaggaagaataagaaaaccatgttctatcttaccacagttcctcactaaaac

SEQ ID NO: 358264 - DNA, 2601 bp, Homo sapiens
ttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttgtaagtgtttgatcttcaagattccttgctgtttgatctatatgatttggttaatggctctgatgtcttttggttttctagaatgttaatagaaatttacccaagtcggtgaactgaaggacatctaagatattttgtttagttcagttaatatttgcacacacaatgaatgtgtgacaggaaggatgtataagcagtcgtccaaccatatggaccat

SEQ ID NO: 358265 - DNA, 447 bp, Homo sapiens
aagtcgtgtcggtaccggtgtgtcatgaaacagatagctgagaccagaccatagaaatacacaggagcaaagagcagcctcttaaaccttcaggctaggtaatgacttgagacgattatgccctacattgtattacttgttcgcaccttcacaatgggtaagtacatttgtgtctagtaaactaaactcagtccgtttttgtatataaaagtagacttaatcattgttaaactatctttcctttttcctttagtctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagacatttgtttcatgacacacggtaccgagctcga

SEQ ID NO: 358266 - DNA, 2518 bp, Homo sapiens
ttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctttctaatgtacagctcactgcactccagcgtgctgaacaagggtctctagt

SEQ ID NO: 358267 - DNA, 895 bp, Homo sapiens
aagtcgtgtcggtaccggtgtgtcatgaaacagatagctgagaccagaccatagaaatacacaggagcaaagagcagcctcttaaaccttcaggctaggtaatgacttgagacgattatgccctacattgtattacttgttcgcaccttcacaatgggtaagtacatttgtgtctagtaaactaaactcagtccgtttttgtatataaaagtagacttaatcattgttaaactatctttcctttttcctttagtctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccgtatgttacataaattacttgatttttgagtacctgttatagaccaggattagttgataaggaccaaaatagaaggtagttatctaaacagttcttcctactgctgctgttccaggcacagtgttatacaccatcactctgccttcactggagtgtatgtttcatcccttctctttatgtaagatggctatacattagaatagggacattagaagaacaaaggccctagcaagtaaaggacaagggttctagaaaaatagtgataaaagtatttacagtttgagaggtaagagatgtggggggagacagtgaggtacccccagaccgccatttttaatagcaccttaactagtgattttatgttttatagcgcccaacgtatgttaacccctagtgatattgctgccttcctttggggatcccccgagaactcattatccccactagttgccccaaagtgaaaaaattttttctctttttcttatc

SEQ ID NO: 358268 - DNA, 2431 bp, Homo sapiens
ttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctggtaatgtattacttactttttaagctcctccccttttcttaccatatttactccttaggagtgagaggttagaagttctttgccccagctagagatatcatagcagatttctacttacaccacttccctgtttctctcagtaattgtttccttccccagagaagagttaatactgtttgtaattcctaaagcccctaaaatgaaaatgtacacacttattcttgttcttctacgtaaactatcaggaggaaataaaatcatgccacataacgatttaatttttatgtttttagagacagggtctagcttggttgtccaggccgacatgcagtggtgtgatcatagctcactgtaaccttaaacctgtcggctcaagtgattctcccacctcagcctcctgaatagctcggactacaggcacacaccaccatgtccagctattttttttcgtagagatgaggtcttgccatgttacccaggttggtct

SEQ ID NO: 358269 - DNA, 1230 bp, Homo sapiens
ttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagaagtgttgcggagataggaacatgggagagaaacaatctgggtaacatgaaagtgatgctggttgctaagggaaggcaacttgattctgtgggaagggctgtagctgatccatccgttgtctaggtaagtctgcttctgttgcaaggatctcacatgatttgcaaatttgtcaaaactagatcatgatttccatttacctttattttgggaatggcataattactattgtaaaatgaatgatgtccttttcaaatagtaatttgcatagtaaaattttaatgaattattggatctttaccatgtaaatgttaatatatttaagtttttgtgccaaaggaaaatacattcacttcagtggtaaatatatgaatggactaatatcttgtgtataggagccagagagagccaggcgtgttggcacgtgcctgtacccagctattcgggtggctaagacaggagtatcacttgagctcagaagttcaaggctctagggcccttaagactgtgcctgtgaatagcctctgcactccagcctgggcaacaatgaagaccccttctcta

SEQ ID NO: 358270 - DNA, 360 bp, Homo sapiens
tggaaattcaatttattgaatttgatagtttattcttggaacatttaagtgtcacttttgtatctcttgcatcatcttaaaagtttatatttgatttattaatgaattagtgatatattatttttctaaatgccgttgatgacctttaacattaaaacaaattttaaaagcatagtatatccatatgcattttatcagaaatccctaaatcaaagaaatgtaacccatttaggcacgcggaataaaagatgctacagaaatcatctttgagatgtcaaaagacgaaagaaaagatttctacaggactatagcatggggtctgaaccggcctttgtttgcagtttatagaagagtgcttcg

SEQ ID NO: 358271 - DNA, 3743 bp, Homo sapiens
gcggccgcagctccgtttccggtggctcgtcgcgctcgctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358272 - DNA, 3954 bp, Homo sapiens
gcggccgcagctccgtttccggtggctcgtcgcgctcgctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagaaaaaggcaattgctgcctgtttttttttcacccacagacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358273 - DNA, 397 bp, Homo sapiens
cagcacagaggagggcggagataggaacatgggagagaaacaatctgggttacatgaaagtgatgctggttgctaggacagcacagaggagggcagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgtgtgcggtccagctgtccacctcctctgtgctgtccacctcctctgtgctgtccagctgtcca

SEQ ID NO: 358274 - DNA, 4350 bp, Homo sapiens
cgcccagtggagcctgtccggcccccttgctgcccgctagctcccgccggctggcgcaagctgtcggcgccggggcactgcgggcggggtcggagcctggccttcctgacgttgcagctgccgtccccgcacgttccggccagggcctccctcttagggccgggcggtgcccgtggctcaggctgcagagtagggaagcgagcggctgccgaggcacagcggcgatccggcgggggcggaaaatggcggcggcttcggaggagctaaatggcgccgggacccctggggggtggggtgggccgggaggttgagtagagaactgggccagaaggagtggagacattgataggctcaccccaaaatatgcttttggggactgatttagcacctgcatattctgcgtgaatctctttaattggttgcagttgagctaatggtggagccaaaatgctattgccctgtcttcatcaacatttaatcaagaacgtttgtctgcctgatgagagccacttgggttaagaaactacctgtgaatagtcatcatttctgtccttcattggggaatacttttagaggccaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358275 - DNA, 4321 bp, Homo sapiens
ttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgatggtggtctgtcggagaatcaatgttctttttgtctacccatctcccttcagtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358276 - DNA, 2227 bp, Homo sapiens
aagtcgtgtcggtaccggtgtgtcatgaaacagatagctgagaccagaccatagaaatacacaggagcaaagagcagcctcttaaaccttcaggctaggtaatgacttgagacgattatgccctacattgtattacttgttcgcaccttcacaatgggtaagtacatttgtgtctagtaaactaaactcagtccgtttttgtatataaaagtagacttaatcattgttaaactatctttcctttttcctttagtctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358277 - DNA, 4295 bp, Homo sapiens
ttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358278 - DNA, 2056 bp, Homo sapiens
atttacaactttaacaggttctttaatgttttatagccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacaggtactgtaatataatacttactatgtgcctgataaattttagatggaaaaaaacagacatttaattaacttgtttcagtctttcttgatccaataagctactagtcctgttgagttctacactgtggtagaataccttaaattcttgacatggattagagaataaatatatacatttaagactaacttgaaactcattacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 358279 - DNA, 3108 bp, Homo sapiens
ttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccgtatgttacataaattacttgatttttgagtacctgttatagaccaggattagttgataaggaccaaaatagaaggtagttatctaaacagttcttcctactgctgctgttccaggcacagtgttatacaccatcactctgccttcactggagtgtatgtttcatcccttctctttatgtaagatggctatacattagaatagggacattagaagaacaaaggccctagcaagtaaaggacaagggttctagaaaaatagtgataaaagtatttacagtttgagaggtaagagatgtggggggagacagtgaggtacccccagaccgccatttttaatagcaccttaactagtgattttatgttttatagcgcccaacgtatgttaacccctagtgatattgctgccttcctttggggatcccccgagaactcattatccccactagttgccccaaagtgaaaaaattttttctctttttcttatc

SEQ ID NO: 358280 - DNA, 2488 bp, Homo sapiens
ttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctggtaatgtattacttactttttaagctcctccccttttcttaccatatttactccttaggagtgagaggttagaagttctttgccccagctagagatatcatagcagatttctacttacaccacttccctgtttctctcagtaattgtttccttccccagagaagagttaatactgtttgtaattcctaaagcccctaaaatgaaaatgtacacacttattcttgttcttctacgtaaactatcaggaggaaataaaatcatgccacataacgatttaatttttatgtttttagagacagggtctagcttggttgtccaggccgacatgcagtggtgtgatcatagctcactgtaaccttaaacctgtcggctcaagtgattctcccacctcagcctcctgaatagctcggactacaggcacacaccaccatgtccagctattttttttcgtagagatgaggtcttgccatgttacccaggttggtct

SEQ ID NO: 358281 - DNA, 414 bp, Homo sapiens
tgtttacaatttggtgagtttggacataagtataccctcatgttaccatcaccacagtccaggtaattaatatatccatcacctccaaaagttctctgatgtccttttggttttgttttgttctgtttgttttgtgctgttatggtaagaacacgtaacatgattgggaggccgaggtgggcggatcacgaggtcaggagatcgagaccatcctggctaacacggtgaaaccccatctctactaaaaatacaaaaaattagctgggcgtggtggcgggcgcctgtagtcccagctactcgggaggctgaggcaggagaatggtgtgaacctggggaggtggagctttcagtgagctgagatcgggccactgcactccaacctgggtgacagagccagatactgtctcaaaaaaa

SEQ ID NO: 358282 - DNA, 234 bp, Homo sapiens
caaaactccgtatttaaaaaaaaaaaaaaaaaaaaaatctaaagaagagttctaaaaatatttctaaccaacgacttggaatatatataaagttctgagttctagcctgcttattgggaggaaaaaaactaagtttcattactttatattcatgcttctttagtcaaatagccactatccattttataatagaacctttcagtatttaacacagatacaccatttaataattaa

SEQ ID NO: 358283 - DNA, 841 bp, Homo sapiens
tactttttcaggtgcttgacaataaatttaattcaggtgaaggctcttcccttcgtgcaggcaccaggggtgtatatgagatgcagcatgcctcatagtgatggtgcaaggcatggcatcaaagccaggctgaggcccctccggatgtcagtggagctaacaaacacatgagtgccaaggcccaaggaacagcactttcagcatgtaggaagaaactggattctggaagcttgaattctggcacctagaagctgcaaacccgaagcactgaaagtgaatgcaaagacaggaaggagtggggtggaggcttctgataccaagtgggtgtcgcaaatgagccatacccgaagatcacaagccccacaggagcagggcctaatgggtgggcgggttgggggcttagagctgaagccttttacggccaaccccaccaatcccagtgctagggagtcgccaaggtggacatggagctataggctgtgccgtcctaggaaccaacaaaggttaagaaccactcctgctgagtaccagcaacatggaagacagtggagtgactgcctgcttactcatgcttttgtttttccaatctagaaagtctacagaaactcctgggagcagacccgggctggcagttatgacttcaggctggatgccatccccttccagactgcccgggcatctagggagatcgccagtgatgtaagacccccatgttctctcctgcggtcactgatgagtttttctctggttttcccagttctgttgaaaggcaaaccaccaggacctgtcaagattatctctctctctgcaccaaaactgaacatgtactgtattttaaatg

SEQ ID NO: 358284 - DNA, 866 bp, Homo sapiens
gcataataagatcaagaacttagtgttgttctgaatgggacattgaagcacaaatccagcttctgcgtcatacatggtttcctcttgctttagccttaatctggggttgagaagactcttgtgtctcccaaaaatggctgacaactccttgagggctgaggacttattactctgcccaggcccagtgcctggcccacaccaggtgcttagcaagcatgtgttgaactccacattgggtgtctccatgtgccaggcactgtgctgggtattgggaataagaagatgaataagatgcacatggcccatcaaactgtaagccaattatgtgccttatgagctatgacaggagatgggcaggatgtcatggaacccttagcagagcatctcactaagatcatctgataaacatggggcatgtgattcacatgttttttcatttcaggtgagatacacagaggactatgaacaacaaagagggaaaggcagtttccctgcgatgatcacacccgcctatcagatagccaaaagagccaatgagctggcaagtgatgtaagtgtccttgacaatgtggtcatgttagggagaaagaggaatgtgaacctgggtctgaggagtccaacttcctgttgacttttgcatttaccctgaagccagggagtagttttcctttatagttttaagtcatttacatgacatgactgctttttgttggaaaactatcctagatcaaggaaagaaatcctagaatacttaccttggcgggggggaaacccgtgcctcgcgaaggggcccctacaaaggggggggccgagggttcgggcaacatgaaaaacctgtgggaaaaagggtgtttcataagcattca

SEQ ID NO: 358285 - DNA, 1914 bp, Homo sapiens
gaaggagcgagggaaactcatagggccccagagtgtaagagacgacccccggatccagcactgccggcgcatgggccagctgcagagcgagcttcagtacaggaggggggcgaccagcagccaagcccagttccatctgcccatggacatggtgcacctggtccatgccaagaatgcccaggctctggccagcgaccacgactacaggacacagtatcacaagttcacagcactgcccgaggacctgaagatggcctgggccaagaaagcccatgccctgcagagtgagttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagacctggttcatgccaagaacagctatatgcactgcaatgagcgcatgtatagatctggagatgcagaatccctgcacagatacaccctgatccccgaccatcccgatttcacccgagctcgcctcaatgcgctgcatctgagtgacaaagtctacagaaactcctgggagcagacccgggctggcagttatgacttcaggctggatgccatccccttccagactgcccgggcatctagggagatcgccagtgatttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaagcagatggagaatgttgtatttgtggtcctctctgatacctagacgtggatggctgattctgttgagtgcctcgagtgtctgggctgaggaataaagatgtgatggtggttcccgctgatgctggggattctggagtctgcatttgcaggatgcctgtggtggaggcagtctctgtgaacactgattttctagaaggtacaattgggtaaggaaagcaaacatactatgttgtgttgattccatcattccttgggttaccaagggaggcagaagaagcctggtgatattgtgcaaatgctggtctgggaaggcccaggctgggtggcagttgtctctgcttagagtagggatagtctactgtgtggtcccctggaggctctggaggtgtccattgttggccatgaggcctcccggtgtcagggtgccaaggagagtgggctctgaggtccagaagacagtaccttagaagccactttcacttttgatggtggctttgatccaattcaggaatttggt

SEQ ID NO: 358286 - DNA, 1907 bp, Homo sapiens
tactttttcaggtgcttgacaataaatttaattcaggtgaaggctcttcccttcgtgcaggcaccaggggtgtatatgagatgcagcatgcctcatagtgatggtgcaaggcatggcatcaaagccaggctgaggcccctccggatgtcagtggagctaacaaacacatgagtgccaaggcccaaggaacagcactttcagcatgtaggaagaaactggattctggaagcttgaattctggcacctagaagctgcaaacccgaagcactgaaagtgaatgcaaagacaggaaggagtggggtggaggcttctgataccaagtgggtgtcgcaaatgagccatacccgaagatcacaagccccacaggagcagggcctaatgggtgggcgggttgggggcttagagctgaagccttttacggccaaccccaccaatcccagtgctagggagtcgccaaggtggacatggagctataggctgtgccgtcctaggaaccaacaaaggttaagaaccactcctgctgagtaccagcaacatggaagacagtggagtgactgcctgcttactcatgcttttgtttttccaatctagaaagtctacagaaactcctgggagcagacccgggctggcagttatgacttcaggctggatgccatccccttccagactgcccgggcatctagggagatcgccagtgatttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaagcagatggagaatgttgtatttgtggtcctctctgatacctagacgtggatggctgattctgttgagtgcctcgagtgtctgggctgaggaataaagatgtgatggtggttcccgctgatgctggggattctggagtctgcatttgcaggatgcctgtggtggaggcagtctctgtgaacactgattttctagaaggtacaattgggtaaggaaagcaaacatactatgttgtgttgattccatcattccttgggttaccaagggaggcagaagaagcctggtgatattgtgcaaatgctggtctgggaaggcccaggctgggtggcagttgtctctgcttagagtagggatagtctactgtgtggtcccctggaggctctggaggtgtccattgttggccatgaggcctcccggtgtcagggtgccaaggagagtgggctctgaggtccagaagacagtaccttagaagccactttcacttttgatggtggctttgatccaattcaggaatttggt

SEQ ID NO: 358287 - DNA, 1782 bp, Homo sapiens
  misc_feature (4)..(4): n is a, c, g, or t
  misc_feature (26)..(26): n is a, c, g, or t
cccngagttcatcctgagcaaaaacngaatgcagccaaccttgagtgacgcaagatacaaagagtcctggcgtaatcttcgtgctcaaggctacaagctgacaatagaagcgctccccttccaggctgcccgggcctctggagatatagccagtgatttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagacctggttcatgccaagaacagctatatgcactgcaatgagcgcatgtatagatctggagatgcagaatccctgcacagatacaccctgatccccgaccatcccgatttcacccgagctcgcctcaatgcgctgcatctgagtgacaaagtctacagaaactcctgggagcagacccgggctggcagttatgacttcaggctggatgccatccccttccagactgcccgggcatctagggagatcgccagtgatttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaagcagatggagaatgttgtatttgtggtcctctctgatacctagacgtggatggctgattctgttgagtgcctcgagtgtctgggctgaggaataaagatgtgatggtggttcccgctgatgctggggattctggagtctgcatttgcaggatgcctgtggtggaggcagtctctgtgaacactgattttctagaaggtacaattgggtaaggaaagcaaacatactatgttgtgttgattccatcattccttgggttaccaagggaggcagaagaagcctggtgatattgtgcaaatgctggtctgggaaggcccaggctgggtggcagttgtctctgcttagagtagggatagtctactgtgtggtcccctggaggctctggaggtgtccattgttggccatgaggcctcccggtgtcagggtgccaaggagagtgggctctgaggtccagaagacagtaccttagaagccactttcacttttgatggtggctttgatccaattcaggaatttggt

SEQ ID NO: 358288 - DNA, 3510 bp, Homo sapiens
  misc_feature (2720)..(2720): n is a, c, g, or t
ctagaaggtcagcaaaggaaagtggaagttggattctgaaagatcgaggtgcccataggaattttatggtcgtcggattttgaagacttgaactagactgggggttctccttgcatttcttgcctgttgcctatctttgtcctctctcttccggcttcgagatgaatgtgcagccctgttctaggtgtgggtatggggtttatcctgccgagaagatcagctgtatagatcagatatggcataaagcctgttttcactgtgaagtttgcaagatgatgctgtctgttaataactttgtgagtcaccagaaaaagccgtactgtcacgcccataaccctaagaacaacactttcaccagtgtctatcacactccattaaatctaaatgtgaggacatttccagaggccatcagtgggatccatgaccaagaagatggtgaacagtgtaaatcagtttttcattgggacatgaaatccaaggataaggaaggtgcacctaacaggcagccactggcaaatgagagagcctattggactggatatggggaagggaatgcttggtgcccaggagctctgccagaccccgaaattgtaaggatggttgaggctcgaaagtctcttggtgaggaatatacagaagactatgagcaacccaggggcaaggggagctttccagccatgatcacacctgcttatcaaagggccaagaaagccaaccagctggccagccaagtggagtataagagagggcatgatgaacgcatctccaggttctccacggtggcggatactcctgagcttctacggagcaaggctggggcacagcttcaaagtgatgtgagatacacagaggactatgaacaacaaagagggaaaggcagtttccctgcgatgatcacacccgcctatcagatagccaaaagagccaatgagctggcaagtgatgtgaggtaccatcaacaatatcaaaaagaaatgaggggaatggctggtccagccattggaactgagggcatcttgacaagggaatgtgcagaccaatatggccagggttacccggaggagtatgaggagcacaggggaaagggcagcttcccagctatgatcactccagcatatcagaacgccaagaaagctcacgaactcgctagtgacataaaatacaggcaggacttcaataagatgaaaggcgctgcacattatcactcgcttccagctcaagacaacttggttctcaaacaggctcagagcgtaaacaaactcgtgagtgaggtggagtataagaaggatctggaaagtagtagaggtcacagtatcaactactgtgaaacacctcaattcaggaacgtgagcaagatctcaaaatttaccagtgataataaatataaagaaaactaccagaaccacatgagaggccgctatgaaggagttggtatggacagacgcactctgcatgctatgaaagttggcagcctggcaagcaacgttgcctacaaagctgattataaacatgatattgtcgactacaactacccagccactctcacgccttcctatcaaacagctatgaaactggtgcccttgaaagatgccaattataggcagagcatcgacaagttgaagtacagctcggtgactgacaccccacagattgttcaagccaaaatcaatgcccagcagctgagtcatgtgaattaccgtgctgactatgagaaaaataagttgaattacacattgccccaggatgttcctcagctggtgaaggccaaaaccaatgccaaactcttcagtgaggttaagtataaagaaggctgggagaagacaaaggggaaaggatttgagatgaagctggatgccatgtctctgctggccgccaaagcctctggggagcttgctagcaatattaaatataaagaagaatatgaaaagacaaaaggcaaagccatgggaacagccgactctaggcttctgcactccctgcagattgctaagatgagcagtgaggttgaatataagaaaggctttgaagagagtaagacccggtttcacctgcccatggatatggtaaacatcaggcatgctaagaaggcccaaactctcgccagtgacctggactacaggaagaaactgcatgaatacactgtgctgcctgaagatatgaagactcagtgggccaagaaggcctatgggctccagagcgagctgcagtacaaggctgacctggcatggatgaagggagttgggtggctgacagaggggagtctcaacttggaacaagccaagaaggctggacagctggtcagcgagaaaaactaccggcagagggtcgatgagctgaagttcaccagcgtgaccgacagctcccagatggagcacgccaagaagagccaggagctacagagcggggtggcctacaaggcaggaaatgagcagtctgtccatcagtataccatcagcaaagacgagcctctcttcctgcaggcccgagccaatgctgcaaatctcagcgagaaactgtataagagcagctgggaaaaccagaaagcaaaagggtttgagctgcgtcttgattccttgaccttcctggcagccaaagccaagagggacctggctagcgaggtgaagtacaaggaggattatgagagatccagagggaagctcattggggcaaaagatgtacagggagattcgcaaatgagccactcactgcaaatgtccaanctgcagagtgagctggagtacaagaagggattcgaggacaccaaatcccaatgccacgtctccctggacatggtccacctcgtgcatgcccgcaaagctcagcatttagccacagacgtaggctacaagacagcggaacatcactttacggctttgcccacagacatgaaggtggaatgggccaagaaggcttatggcttacagagtgataagaagtaccgtcagcatccagatgctttgaagtttaccagtattaaagacactccggagatggtccaggccagaattagttatacccaagcagtggatagattatacagggaacaaggagaaaacataaagcatcattacacaccgactgctgacctccctgaagtcctgctggccaagctgaatgccatgaatatcagtgagacgcgttataaggaatcctggagcaaacttcgagatggtggctataaactgaggttggatgcccttccattccaagcagcaaaggcttctggtgaaatcataagtgattacaaatacaaagaggcatttgagaaaatgaaaggacagatgcttggttcccggagcttggaagatgatatcagccttgcacattcagtgtatgcgacctcactgcagagtgatgtgaattacaagaaaggctttgaacactcaaaggcgcagttccatctgccgttggacatggccgccctggtgcatgccaagaaggctcagaccctggccagcaatcaggactacaaacatccactgccccagtacacttccttggcagaagacc

SEQ ID NO: 358289 - DNA, 1579 bp, Homo sapiens
ctatgtgagaatgggcacatttatcttcctgttggagtattaattacaatagtgacaataccagtagccaccactcagtgggccagagctgatgccagacatgaagctcagtccttatctggttgaatcctcgcaacctcctatggggtgtagatcattctccaattttatcagatggggaaactgaggctcatggagaaactcagtaacaggcccatgaccacacagataggtctatttgaatccaaagcctgtgcctctaacccactcttgagcctcctgctgagaatgccctgggatggccccatatgtgaggctggtcctgggggaggtaggcacccatgatctgcctctgctcctctgacttgcagttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaagcagatggagaatgttgtatttgtggtcctctctgatacctagacgtggatggctgattctgttgagtgcctcgagtgtctgggctgaggaataaagatgtgatggtggttcccgctgatgctggggattctggagtctgcatttgcaggatgcctgtggtggaggcagtctctgtgaacactgattttctagaaggtacaattgggtaaggaaagcaaacatactatgttgtgttgattccatcattccttgggttaccaagggaggcagaagaagcctggtgatattgtgcaaatgctggtctgggaaggcccaggctgggtggcagttgtctctgcttagagtagggatagtctactgtgtggtcccctggaggctctggaggtgtccattgttggccatgaggcctcccggtgtcagggtgccaaggagagtgggctctgaggtccagaagacagtaccttagaagccactttcacttttgatggtggctttgatccaattcaggaatttggt

SEQ ID NO: 358290 - DNA, 2493 bp, Homo sapiens
ctagaaggtcagcaaaggaaagtggaagttggattctgaaagatcgaggtgcccataggaattttatggtcgtcggattttgaagacttgaactagactgggggttctccttgcatttcttgcctgttgcctatctttgtcctctctcttccggcttcgagatgaatgtgcagccctgttctaggtgtgggtatggggtttatcctgccgagaagatcagctgtatagatcagatatggcataaagcctgttttcactgtgaagtttgcaagatgatgctgtctgttaataactttgtgagtcaccagaaaaagccgtactgtcacgcccataaccctaagaacaacactttcaccagtgtctatcacactccattaaatctaaatgtgaggacatttccagaggccatcagtgggatccatgaccaagaagatggtgaacagtgtaaatcagtttttcattgggacatgaaatccaaggataaggaaggtgcacctaacaggcagccactggcaaatgagagagcctattggactggatatggggaagggaatgcttggtgcccaggagctctgccagaccccgaaattgtaaggatggttgaggctcgaaagtctcttggtgaggaatatacagaagactatgagcaacccaggggcaaggggagctttccagccatgatcacacctgcttatcaaagggccaagaaagccaaccagctggccagccaagtggagtataagagagggcatgatgaacgcatctccaggttctccacggtggcggatactcctgagcttctacggagcaaggctggggcacagcttcaaagtgatgtgagatacacagaggactatgaacaacaaagagggaaaggcagtttccctgcgatgatcacacccgcctatcagatagccaaaagagccaatgagctggcaagtgatgtgaggtaccatcaacaatatcaaaaagaaatgaggggaatggctggtccagccattggaactgagggcatcttgacaagggaatgtgcagaccaatatggccagggttacccggaggagtatgaggagcacaggggaaagggcagcttcccagctatgatcactccagcatatcagaacgccaagaaagctcacgaactcgctagtgacataaaatacaggcaggacttcaataagatgaaaggcgctgcacattatcactcgcttccagctcaagacaacttggttctcaaacaggctcagagcgtaaacaaactcgtgagtgaggtggagtataagaaggatctggaaagtagtagaggtcacagtatcaactactgtgaaacacctcaattcaggaacgtgagcaagatctcaaaatttaccagtgataataaatataaagaaaactaccagaaccacatgagaggccgctatgaaggagttggtatggacagacgcactctgcatgctatgaaagttggcagcctggcaagcaacgttgcctacaaagctgattataaacatgatattgtcgactacaactacccagccactctcacgccttcctatcaaacagctatgaaactggtgcccttgaaagatgccaattataggcagagcatcgacaagttgaagtacagctcggtgactgacaccccacagattgttcaagccaaaatcaatgcccagcagctgagtcatgtgaattaccgtgctgactatgagaaaaataagttgaattacacattgccccaggatgttcctcagctggtgaaggccaaaaccaatgccaaactcttcagtgaggttaagtataaagaaggctgggagaagacaaaggggaaaggatttgagatgaagctggatgccatgtctctgctggccgccaaagcctctggggagcttgctagcaatattaaatataaagaagaatatgaaaagacaaaaggcaaagccatgggaacagccgactctaggcttctgcactccctgcagattgctaagatgagcagtgaggttgaatataagaaaggctttgaagagagtaagacccggtttcacctgcccatggatatggtaaacatcaggcatgctaagaaggcccaaactctcgccagtgacctggactacaggaagaaactgcatgaatacactgtgctgcctgaagatatgaagactcagtgggccaagaaggcctatgggctccagagcgagctgcagtacaaggctgacctggcatggatgaagggagttgggtggctgacagaggggagtctcaacttggaacaagccaagaaggctggacagctggtcagcgaggtaacctgcactggggcctctggcctccagtagtcctcagcccctgacacatgcagggtgatctttgcctctaattccctttctctatcctcagatttattttggctgtgattcaaagtgggagtacttcatttcacacctgtagcacattctcagctaactttccacacccttaaacttactgaga

SEQ ID NO: 358291 - DNA, 306 bp, Homo sapiens
cagtttttcattgggacatgaaatccaaggataaggaaggtgcacctaacaggcagccactggcaaatgaggtgagagaaaagtgacaagtgggtttggaaaaagaaagaatgacatactatgtcaattgagtgtattattattattacttctagagaaaaccaagtaggtttcctttcacccagtttgtaattccagctgtctatggaagacctcaatcagcgtgtcctaatatcacctgaactctatcttccccagaccaggttcattgtcttccccttccaaccactgtatttctatcaccca

SEQ ID NO: 358292 - DNA, 848 bp, Homo sapiens
gaaggagcgagggaaactcatagggccccagagtgtaagagacgacccccggatccagcactgccggcgcatgggccagctgcagagcgagcttcagtacaggaggggggcgaccagcagccaagcccagttccatctgcccatggacatggtgcacctggtccatgccaagaatgcccaggctctggccagcgaccacgactacaggacacagtatcacaagttcacagcactgcccgaggacctgaagatggcctgggccaagaaagcccatgccctgcagagtgagttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagacctggttcatgccaagaacagctatatgcactgcaatgagcgcatgtatagatctggagatgcagaatccctgcacagatacaccctgatccccgaccatcccgatttcacccgagctcgcctcaatgcgctgcatctgagtgacaaagtctacagaaactcctgggagcagacccgggctggcagttatgacttcaggctggatgccatccccttccagactgcccgggcatctagggagatcgccagtgatgtaagacccccatgttctctcctgcggtcactgatgagtttttctctggttttcccagttctgttgaaaggcaaaccaccaggacctgtcaagattatctctctctctgcaccaaaactgaacatgtactgtattttaaatg

SEQ ID NO: 358293 - DNA, 3614 bp, Homo sapiens
  misc_feature (2720)..(2720): n is a, c, g, or t
ctagaaggtcagcaaaggaaagtggaagttggattctgaaagatcgaggtgcccataggaattttatggtcgtcggattttgaagacttgaactagactgggggttctccttgcatttcttgcctgttgcctatctttgtcctctctcttccggcttcgagatgaatgtgcagccctgttctaggtgtgggtatggggtttatcctgccgagaagatcagctgtatagatcagatatggcataaagcctgttttcactgtgaagtttgcaagatgatgctgtctgttaataactttgtgagtcaccagaaaaagccgtactgtcacgcccataaccctaagaacaacactttcaccagtgtctatcacactccattaaatctaaatgtgaggacatttccagaggccatcagtgggatccatgaccaagaagatggtgaacagtgtaaatcagtttttcattgggacatgaaatccaaggataaggaaggtgcacctaacaggcagccactggcaaatgagagagcctattggactggatatggggaagggaatgcttggtgcccaggagctctgccagaccccgaaattgtaaggatggttgaggctcgaaagtctcttggtgaggaatatacagaagactatgagcaacccaggggcaaggggagctttccagccatgatcacacctgcttatcaaagggccaagaaagccaaccagctggccagccaagtggagtataagagagggcatgatgaacgcatctccaggttctccacggtggcggatactcctgagcttctacggagcaaggctggggcacagcttcaaagtgatgtgagatacacagaggactatgaacaacaaagagggaaaggcagtttccctgcgatgatcacacccgcctatcagatagccaaaagagccaatgagctggcaagtgatgtgaggtaccatcaacaatatcaaaaagaaatgaggggaatggctggtccagccattggaactgagggcatcttgacaagggaatgtgcagaccaatatggccagggttacccggaggagtatgaggagcacaggggaaagggcagcttcccagctatgatcactccagcatatcagaacgccaagaaagctcacgaactcgctagtgacataaaatacaggcaggacttcaataagatgaaaggcgctgcacattatcactcgcttccagctcaagacaacttggttctcaaacaggctcagagcgtaaacaaactcgtgagtgaggtggagtataagaaggatctggaaagtagtagaggtcacagtatcaactactgtgaaacacctcaattcaggaacgtgagcaagatctcaaaatttaccagtgataataaatataaagaaaactaccagaaccacatgagaggccgctatgaaggagttggtatggacagacgcactctgcatgctatgaaagttggcagcctggcaagcaacgttgcctacaaagctgattataaacatgatattgtcgactacaactacccagccactctcacgccttcctatcaaacagctatgaaactggtgcccttgaaagatgccaattataggcagagcatcgacaagttgaagtacagctcggtgactgacaccccacagattgttcaagccaaaatcaatgcccagcagctgagtcatgtgaattaccgtgctgactatgagaaaaataagttgaattacacattgccccaggatgttcctcagctggtgaaggccaaaaccaatgccaaactcttcagtgaggttaagtataaagaaggctgggagaagacaaaggggaaaggatttgagatgaagctggatgccatgtctctgctggccgccaaagcctctggggagcttgctagcaatattaaatataaagaagaatatgaaaagacaaaaggcaaagccatgggaacagccgactctaggcttctgcactccctgcagattgctaagatgagcagtgaggttgaatataagaaaggctttgaagagagtaagacccggtttcacctgcccatggatatggtaaacatcaggcatgctaagaaggcccaaactctcgccagtgacctggactacaggaagaaactgcatgaatacactgtgctgcctgaagatatgaagactcagtgggccaagaaggcctatgggctccagagcgagctgcagtacaaggctgacctggcatggatgaagggagttgggtggctgacagaggggagtctcaacttggaacaagccaagaaggctggacagctggtcagcgagaaaaactaccggcagagggtcgatgagctgaagttcaccagcgtgaccgacagctcccagatggagcacgccaagaagagccaggagctacagagcggggtggcctacaaggcaggaaatgagcagtctgtccatcagtataccatcagcaaagacgagcctctcttcctgcaggcccgagccaatgctgcaaatctcagcgagaaactgtataagagcagctgggaaaaccagaaagcaaaagggtttgagctgcgtcttgattccttgaccttcctggcagccaaagccaagagggacctggctagcgaggtgaagtacaaggaggattatgagagatccagagggaagctcattggggcaaaagatgtacagggagattcgcaaatgagccactcactgcaaatgtccaanctgcagagtgagctggagtacaagaagggattcgaggacaccaaatcccaatgccacgtctccctggacatggtccacctcgtgcatgcccgcaaagctcagcatttagccacagacgtaggctacaagacagcggaacatcactttacggctttgcccacagacatgaaggtggaatgggccaagaaggcttatggcttacagagtgataaccatacagggcagatgtgaagtggatgaaaggcatgggctgggtcgccaccgggtcattaaatgtggagcaggcgaagaaggcaggagaactcattagcgagaagaagtaccgtcagcatccagatgctttgaagtttaccagtattaaagacactccggagatggtccaggccagaattagttatacccaagcagtggatagattatacagggaacaaggagaaaacataaagcatcattacacaccgactgctgacctccctgaagtcctgctggccaagctgaatgccatgaatatcagtgagacgcgttataaggaatcctggagcaaacttcgagatggtggctataaactgaggttggatgcccttccattccaagcagcaaaggcttctggtgaaatcataagtgattacaaatacaaagaggcatttgagaaaatgaaaggacagatgcttggttcccggagcttggaagatgatatcagccttgcacattcagtgtatgcgacctcactgcagagtgatgtgaattacaagaaaggctttgaacactcaaaggcgcagttccatctgccgttggacatggccgccctggtgcatgccaagaaggctcagaccctggccagcaatcaggactacaaacatccactgccccagtacacttccttggcagaagacc

SEQ ID NO: 358294 - DNA, 1809 bp, Homo sapiens
gaaggagcgagggaaactcatagggccccagagtgtaagagacgacccccggatccagcactgccggcgcatgggccagctgcagagcgagcttcagtacaggaggggggcgaccagcagccaagcccagttccatctgcccatggacatggtgcacctggtccatgccaagaatgcccaggctctggccagcgaccacgactacaggacacagtatcacaagttcacagcactgcccgaggacctgaagatggcctgggccaagaaagcccatgccctgcagagtgagttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagacctggttcatgccaagaacagctatatgcactgcaatgagaaagtctacagaaactcctgggagcagacccgggctggcagttatgacttcaggctggatgccatccccttccagactgcccgggcatctagggagatcgccagtgatttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaagcagatggagaatgttgtatttgtggtcctctctgatacctagacgtggatggctgattctgttgagtgcctcgagtgtctgggctgaggaataaagatgtgatggtggttcccgctgatgctggggattctggagtctgcatttgcaggatgcctgtggtggaggcagtctctgtgaacactgattttctagaaggtacaattgggtaaggaaagcaaacatactatgttgtgttgattccatcattccttgggttaccaagggaggcagaagaagcctggtgatattgtgcaaatgctggtctgggaaggcccaggctgggtggcagttgtctctgcttagagtagggatagtctactgtgtggtcccctggaggctctggaggtgtccattgttggccatgaggcctcccggtgtcagggtgccaaggagagtgggctctgaggtccagaagacagtaccttagaagccactttcacttttgatggtggctttgatccaattcaggaatttggt

SEQ ID NO: 358295 - DNA, 3329 bp, Homo sapiens
ctagaaggtcagcaaaggaaagtggaagttggattctgaaagatcgaggtgcccataggaattttatggtcgtcggattttgaagacttgaactagactgggggttctccttgcatttcttgcctgttgcctatctttgtcctctctcttccggcttcgagatgaatgtgcagccctgttctaggtgtgggtatggggtttatcctgccgagaagatcagctgtatagatcagatatggcataaagcctgttttcactgtgaagtttgcaagatgatgctgtctgttaataactttgtgagtcaccagaaaaagccgtactgtcacgcccataaccctaagaacaacactttcaccagtgtctatcacactccattaaatctaaatgtgaggacatttccagaggccatcagtgggatccatgaccaagaagatggtgaacagtgtaaatcagtttttcattgggacatgaaatccaaggataaggaaggtgcacctaacaggcagccactggcaaatgagagagcctattggactggatatggggaagggaatgcttggtgcccaggagctctgccagaccccgaaattgtaaggatggttgaggctcgaaagtctcttggtgaggaatatacagaagactatgagcaacccaggggcaaggggagctttccagccatgatcacacctgcttatcaaagggccaagaaagccaaccagctggccagccaagtggagtataagagagggcatgatgaacgcatctccaggttctccacggtggcggatactcctgagcttctacggagcaaggctggggcacagcttcaaagtgatgtgagatacacagaggactatgaacaacaaagagggaaaggcagtttccctgcgatgatcacacccgcctatcagatagccaaaagagccaatgagctggcaagtgatgtgaggtaccatcaacaatatcaaaaagaaatgaggggaatggctggtccagccattggaactgagggcatcttgacaagggaatgtgcagaccaatatggccagggttacccggaggagtatgaggagcacaggggaaagggcagcttcccagctatgatcactccagcatatcagaacgccaagaaagctcacgaactcgctagtgacataaaatacaggcaggacttcaataagatgaaaggcgctgcacattatcactcgcttccagctcaagacaacttggttctcaaacaggctcagagcgtaaacaaactcgtgagtgaggtggagtataagaaggatctggaaagtagtagaggtcacagtatcaactactgtgaaacacctcaattcaggaacgtgagcaagatctcaaaatttaccagtgataataaatataaagaaaactaccagaaccacatgagaggccgctatgaaggagttggtatggacagacgcactctgcatgctatgaaagttggcagcctggcaagcaacgttgcctacaaagctgattataaacatgatattgtcgactacaactacccagccactctcacgccttcctatcaaacagctatgaaactggtgcccttgaaagatgccaattataggcagagcatcgacaagttgaagtacagctcggtgactgacaccccacagattgttcaagccaaaatcaatgcccagcagctgagtcatgtgaattaccgtgctgactatgagaaaaataagttgaattacacattgccccaggatgttcctcagctggtgaaggccaaaaccaatgccaaactcttcagtgaggttaagtataaagaaggctgggagaagacaaaggggaaaggatttgagatgaagctggatgccatgtctctgctggccgccaaagcctctggggagcttgctagcaatattaaatataaagaagaatatgaaaagacaaaaggcaaagccatgggaacagccgactctaggcttctgcactccctgcagattgctaagatgagcagtgaggttgaatataagaaaggctttgaagagagtaagacccggtttcacctgcccatggatatggtaaacatcaggcatgctaagaaggcccaaactctcgccagtgacctggactacaggaagaaactgcatgaatacactgtgctgcctgaagatatgaagactcagtgggccaagaaggcctatgggctccagagcgagctgcagtacaaggctgacctggcatggatgaagggagttgggtggctgacagaggggagtctcaacttggaacaagccaagaaggctggacagctggtcagcgagaaaaactaccggcagagggtcgatgagctgaagttcaccagcgtgaccgacagctcccagatggagcacgccaagaagagccaggagctacagagcggggtggcctacaaggcaggaaatgagcagtctgtccatcagtataccatcagcaaagacgagcctctcttcctgcaggcccgagccaatgctgcaaatctcagcgagaaactgtataagagcagctgggaaaaccagaaagcaaaagggtttgagctgcgtcttgattccttgaccttcctggcagccaaagccaagagggacctggctagcgaggtgaagtacaaggaggattatgagagatccagagggaagctcattggggcaaaagatgtccaccctgattcctgagaggccagagaggaagtttgttcaccagagacaggcttcagatggctttgatttcggcaagctggaatggcccaccagcccatcccagatcttcctttattaaaataataactctgaaagcagatggagaatgttgtatttgtggtcctctctgatacctagacgtggatggctgattctgttgagtgcctcgagtgtctgggctgaggaataaagatgtgatggtggttcccgctgatgctggggattctggagtctgcatttgcaggatgcctgtggtggaggcagtctctgtgaacactgattttctagaaggtacaattgggtaaggaaagcaaacatactatgttgtgttgattccatcattccttgggttaccaagggaggcagaagaagcctggtgatattgtgcaaatgctggtctgggaaggcccaggctgggtggcagttgtctctgcttagagtagggatagtctactgtgtggtcccctggaggctctggaggtgtccattgttggccatgaggcctcccggtgtcagggtgccaaggagagtgggctctgaggtccagaagacagtaccttagaagccactttcacttttgatggtggctttgatccaattcaggaatttggt

SEQ ID NO: 358296 - DNA, 2991 bp, Homo sapiens
  misc_feature (2097)..(2097): n is a, c, g, or t
actcagggcagagcctggctgctgggcagaagggcacttgggcgggctgcttcagagagggccattcggtgtcctggcccacagagagagtaaacagtgagagaccaagagagcaaaccagagagatagggagggggaatgcaaggggtccctgggggactcaggggtcccagtggagaatgagaggcaggccccccgtggtgggccggggacctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctcacccagggtggtccggcggcgggtcttcctgaaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaagagagtatgacccgtttcacctgcccatggatatggtaaacatcaggcatgctaagaaggcccaaactctcgccagtgacctggactacaggaagaaactgcatgaatacattaaatataaagaagaatatgaaaagacaaaaggcaaagccatgggaacagccgactctaggcttctgcactccctgcagattgctaagatgagcagtgaggttgaatataagaaaggctttgaagagagtaagacccggtttcacctgcccataaactctcgccagtgacctggactacaggaagaaactgcatgaatacactgtgctgcctgaagatatgaagactcagtgggccaagaaggcctatgggctccagagcgagctgcagtacaaggctgacctggcatggatgaagggagttgggtggctgacagaggggagtctcaacttggaacaagccaagaaggctggacagctggtcagcgagaaaaactaccggcagagggtcgatgagctgaagttcaccagcgtgaccgacagctcccagatggagcacgccaagaagagccaggagctacagagcggggtggcctacaaggcaggaaatgagcagtctgtccatcagtataccatcagcaaagacgagcctctcttcctgcaggcccgagccaatgctgcaaatctcagcgagaaactgtataagagcagctgggaaaaccagaaagcaaaagggtttgagctgcgtcttgattccttgaccttcctggcagccaaagccaagagggacctggctagcgaggtgaagtacaaggaggattatgagagatccagagggaagctcattggggcaaaagatgtacagggagattcgcaaatgagccactcactgcaaatgtccaanctgcagagtgagctggagtacaagaagggattcgaggacaccaaatcccaatgccacgtctccctggacatggtccacctcgtgcatgcccgcaaagctcagcatttagccacagacgtaggctacaagacagcggaacatcactttacggctttgcccacagacatgaaggtggaatgggccaagaaggcttatggcttacagagtgataaccatacagggcagatgtgaagtggatgaaaggcatgggctgggtcgccaccgggtcattaaatgtggagcaggcgaagaaggcaggagaactcattagcgagaagaagtaccgtcagcatccagatgctttgaagtttaccagtattaaagacactccggagatggtccaggccagaattagttatacccaagcagtggatagattatacagggaacaaggagaaaacataaagcatcattacacaccgactgctgacctccctgaagtcctgctggccaagctgaatgccatgaatatcagtgagacgcgttataaggaatcctggagcaaacttcgagatggtggctataaactgaggttggatgcccttccattccaagcagcaaaggcttctggtgaaatcataagtgattacaaatacaaagaggcatttgagaaaatgaaaggacagatgcttggttcccggagcttggaagatgatatcagccttgcacattcagtgtatgcgacctcactgcagagtgatgtgaattacaagaaaggctttgaacactcaaaggcgcagttccatctgccgttggacatggccgccctggtgcatgccaagaaggctcagaccctggccagcaatcaggactacaaacatccactgccccagtacacttccttggcagaagacc

SEQ ID NO: 358297 - DNA, 235 bp, Homo sapiens
aataatcataagtattcgttttatggaacaattggaccagtttcagaatgtttccatgagctgagcagacaacattaggggttctttttctttcttttttaaagtctgttaaaccttccattttttttttttcccgagacagagtctctctctgtcacccaggctggggggcagtggcgtggtcttggctgactgtaacctccgcctcctggattcaaatgattctcttgcctct

SEQ ID NO: 358298 - DNA, 314 bp, Homo sapiens
cagaaacgcattccccagaacctggtgtttcatgcccggtaacaacataattaccatcataaagataaatcgttaccggagatccagacagccacccattttcatagctgcgaaagccacagtgaaacatctaagtccagtcaccataatcgtaaagccaccaagaactactagcagacgacgtcaacagaatgattaataaacatcttatttggttattttcagagcatataactccagaactaacttgatcagcttctcttactaaaatgtgcaaaaattttttaaatttctttttccttagggttgtcgct

SEQ ID NO: 358299 - DNA, 385 bp, Homo sapiens
cagactagcagctcagaggcagtttggcactatttatacttacttttaactatatgcaaattaaggggcagtttatgcaggaatttctaggatgaaggtggtaacttctaggttgttgggttgttgccatggaaaggcatggtaacttccgggtgttgccctggcaaatggtaactgacatggtgccctggtgagtgagtcttatggggatgtgcttcgtcctaacctgttttagctagtcctcaatttggtccggtgtcaaccccaacctccagagtcaagtcccgcctcctacttcaaagtagtactataattttgactctttttaaaattcgtaattgctagaatacttataatttcccccttatttactatttgtaggtag

SEQ ID NO: 358300 - DNA, 605 bp, Homo sapiens
ttgatacagatttagattagggtgataatcacttgcttttggagtctagggtggaagattcagttccatgtgagttctgttcccagcaacagttcttaagtttccttttttttcctgccctatatcattgaatctggtgtatctcggtggttatctactgtgcgagttattgggaatttagaatactagtttctcacttgtaaattagatgttttctgtttatttaactatttggagttgggggagcacaggataacttatataaccaagggagtctagttcagctccagatcatcttttcagatacctgatgccattggtgagcaggtcgtggttccatcactgtgctcacagtttgcgttactctgctggttccattccagccacatcttatctgcattcagcctgtgttggatgtggaccatagtgttggtgcttgcccttagggaaagtgcctctgttggtgtttgacaatgatggtcagtggcatccttcatgccagtcctgggaagaaaaacagagtaaggaaagaaaaagaaaagatttagaagaggagagaacatcacaagtggaagacggaggtgggagaaggatctgacagggaa

SEQ ID NO: 358301 - DNA, 3155 bp, Homo sapiens
gccccctcttctcccctcccccaagccagcacctggtgccccggcgggtcgtgcggcgcggcgctccgcgagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctgtattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaatggaactgatgtgggtatga

SEQ ID NO: 358302 - DNA, 613 bp, Homo sapiens
ggctgttttcccactgtcccttcttcgggcagtgtcgccgtccagcctggttgttgaagcgtccccgtggtcccccggggtccaggcccctttgtggaggcagctgctggcccccagcccatgggaccgtagtcgcggaggcctctgcagaggcgcaggctggaagcggtggcctttgaggggggcggcaggagagagtaccgacctccctcgaactcctggcagagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcattcttgaggtggaaagcccaggtgcagcctctgaggcagtgagtgttcttgaggtggaaagcccaggtggtggtggtctgaggtggaggggctgtttgcacatcttggtataactgctttctctattgtgttgcaaatcatagtagttaccacttactgagcgtttataaacactagaaaaccctgtgcacctttaaataaatgcaaccattttatagatgaa

SEQ ID NO: 358303 - DNA, 459 bp, Homo sapiens
gctgccatccctgggagctggaaccaggcaatgttcgggggaggcaggggacaggctggaaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctaaatatacagcctctgcagacactgcttctgaatgaacgggctggagtttccttgggatcctgaactcatattggattctctacctaccatcttggacaattcatgtaggaaaacaaatcctcatttgttcaaacaatagatgaaaattattaaagttttgacacatattaaat

SEQ ID NO: 358304 - DNA, 3135 bp, Homo sapiens
gccccctcttctcccctcccccaagccagcacctggtgccccggcgggtcgtgcggcgcggcgctccgcgagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctgtattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaa

SEQ ID NO: 358305 - DNA, 3401 bp, Homo sapiens
  misc_feature (36)..(36): n is a, c, g, or t
  misc_feature (101)..(101): n is a, c, g, or t
  misc_feature (169)..(169): n is a, c, g, or t
acagatgaatgggagagccagccgagaaatctaaantgcctcgcatccccagcagtttgctaaaggaggtagtggctggacaggttaagacaccctcccanccccccagcctcctgcagtactcagggtaaccattaggcaccttattctgcagccaccagtggggcantgttgccaagagggtaccaagaggagaatcctgcagccttgagctgtgcaactgataacgaactacagatgggatggacgccatcttacctgatgctggccagtatatcatgacatggagaactccccgctattcctgagaaacttggactttgactcaacagaaagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctgtattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaa

SEQ ID NO: 358306 - DNA, 3292 bp, Homo sapiens
ggctgttttcccactgtcccttcttcgggcagtgtcgccgtccagcctggttgttgaagcgtccccgtggtcccccggggtccaggcccctttgtggaggcagctgctggcccccagcccatgggaccgtagtcgcggaggcctctgcagaggcgcaggctggaagcggtggcctttgaggggggcggcaggagagagtaccgacctccctcgaactcctggcagagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctgtattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaa

SEQ ID NO: 358307 - DNA, 3645 bp, Homo sapiens
gccccctcttctcccctcccccaagccagcacctggtgccccggcgggtcgtgcggcgcggcgctccgcgagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgaggtgagccacatccctctgctgctttgcccagcagagctggttttggaaggcaagaatcttgcttttcttaccccagtttagtttaaagagaaggagaagagatcttaggtctcttcgttcctgtctatagaacagagacttaagatcctgcctcttccttctagtgttcattccctcatctccttgcctactaactcttttttctgatgcctttgcaagtctttagagccagaaatccctttctttttgctctctacctcttttagggtctttagcatatcttgtctgcagctagagatggtcaggggaggggtgagtacagggtcctcttgggcatggttgagagtgcacacctggaagtcctttcccaagtggcctgtgtgtgtctctgtgccccagttcctgaaattcgtgcggcagattggcgaagggcaggtgtccctggagtccggtgcagggtcgggccgagctcaggcagaacagtgggcagcagagtttatacagcagcagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctgtattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaa
